US006630334B1

(12) United States Patent
Guegler et al.

(10) Patent No.: US 6,630,334 B1
(45) Date of Patent: Oct. 7, 2003

(54) ISOLATED HUMAN KINASE PROTEINS, NUCLEIC ACID MOLECULES ENCODING HUMAN KINASE PROTEINS, AND USES THEREOF

(75) Inventors: Karl Guegler, Menlo Park, CA (US); Marion Webster, San Francisco, CA (US); Valentina Di Francesco, Rockville, MD (US); Ellen M. Beasley, Darnestown, MD (US)

(73) Assignee: Applera Corporation, Norwalk, CT (US)

(*) Notice: Subject to any disclaimer, the term of this patent is extended or adjusted under 35 U.S.C. 154(b) by 0 days.

(21) Appl. No.: 09/751,389

(22) Filed: Jan. 2, 2001

(51) Int. Cl.[7] .......................... C12N 9/12; C12N 5/10; C12N 1/21; C07H 21/04; C07H 21/02

(52) U.S. Cl. .................... 435/194; 435/325; 435/252.3; 530/350; 536/23.1

(58) Field of Search ............................ 435/194, 320.1, 435/325, 252.3; 536/23.1, 24.3; 530/350

(56) References Cited

U.S. PATENT DOCUMENTS 5,843,749 A 12/1998 Masiakowski et al.

FOREIGN PATENT DOCUMENTS

WO 01/66594 * 3/2001

OTHER PUBLICATIONS

Maisonpierre P C et al. "EHK–1 and EHK–2: to Novel Members of the EPH Receptor–Like Tyrosinekinase Family with Distinctive Structures and Neuronal Expression." Oncogene. Vol. 8, No. 12, pp. 3277–3288. Dec. 1, 1993. XP000566895.

Lee et al. "Cloning of M–EHK2 From the Murine Inner Ear, and EPH Family Receptor Tyrosine Kinase Expressed in the Developing and Adult Cochlea." DNA and Cell Biology. Vol. 15, No. 10, 1996. XP001122012.

George D G et al. "Current Methods in Sequence Comparison and Analysis." Macromolecular Sequencing and Synthesis Selected Methods and Applications. 1988. pp. 127–149. XP000829541.

Barton G J. "Protein Sequence Alignment and Database Scanning." Protein Structure Prediction. A Practical Approach. 1996. pp. 31–63. XP000829540.

International Search Report dated Feb. 18, 2003.

* cited by examiner

*Primary Examiner*—Stephanie Zitomer
(74) *Attorney, Agent, or Firm*—Celera Genomics; Justin D. Karjala

(57) ABSTRACT

The present invention provides amino acid sequences of peptides that are encoded by genes within the human genome, the kinase peptides of the present invention. The present invention specifically provides isolated peptide and nucleic acid molecules, methods of identifying orthologs and paralogs of the kinase peptides, and methods of identifying modulators of the kinase peptides.

8 Claims, 284 Drawing Sheets

```
   1 GAGGAAAAGA GAGCCTAGGA GAACCATGGG GGGCTGCGAA GTCCGGGAAT
  51 TTCTTTTGCA ATTTGGTTTC TTCTTGCCTC TGCTGACAGC GTGGCCAGGC
 101 GACTGCAGTC ACGTCTCCAA CAACCAAGTT GTGTTGCTTG ATACAACAAC
 151 TGTACTGGGA GAGCTAGGAT GGAAAACATA TCCATTAAAT GGGTGGGATG
 201 CCATCACTGA AATGGATGAA CATAATAGGC CCATTCACAC ATACCAGGTA
 251 TGTAATGTAA TGGAACCAAA CCAAAACAAC TGGCTTCGTA CAAACTGGAT
 301 CTCCCGTGAT GCAGCTCAGA AAATTTATGT GGAAATGAAA TTCACACTAA
 351 GGGATTGTAA CAGCATCCCA TGGGTCTTGG GGACTTGCAA AGAAACATTT
 401 AATCTGTTTT ATATGGAATC AGATGAGTCC CACGGAATTA AATTCAAGCC
 451 AAACCAGTAT ACAAAGATCG ACACAATTGC TGCTGATGAG AGTTTTACCC
 501 AGATGGATTT GGGTGATCGC ATCCTCAAAC TCAACACTGA AATTCGTGAG
 551 GTGGGGCCTA TAGAAAGGAA AGGATTTTAT CTGGCTTTTC AAGACATTGG
 601 GGCGTGCATT GCCCTGGTTT CAGTCCGTGT TTTCTACAAG AAATGCCCCT
 651 TCACTGTTCG TAACTTGGCC ATGTTTCCTG ATACCATTCC AAGGGTTGAT
 701 TCCTCCTCTT TGGTTGAAGT ACGGGGTTCT TGTGTGAAGA GTGCTGAAGA
 751 GCGTGACACT CCTAAACTGT ATTGTGGAGC TGATGGAGAT TGGCTGGTTC
 801 CTCTTGGAAG GTGCATCTGC AGTACAGGAT ATGAAGAAAT TGAGGGTTCT
 851 TGCCATGCTT GCAGACCAGG ATTCTATAAA GCTTTTGCTG GGAACGCAAA
 901 ATGTTCTAAA TGTCCTCCAC ACAGTTTAAC ATACATGGAA GCAACTTCTG
 951 TCTGTCAGTG TGAAAAGGGC TATTTCCGAG CTGAAAAAGA CCCACCTTCT
1001 ATGGCATGTA CCAGGCCACC TTCAGCTCCT AGGAATGTGG TTTTTAACAT
1051 CAATGAAACA GCCCTTATTT TGGAATGGAG CCCACCAAGT GACACAGGAG
1101 GGAGAAAAGA TCTCACATAC AGTGTAATCT GTAAGAAATG TGGCTTAGAC
1151 ACCAGCCAGT GTGAGGACTG TGGTGGAGGA CTCCGCTTCA TCCCAAGACA
1201 TACAGGCCTG ATCAACAATT CCGTGATAGT ACTTGACTTT GTGTCTCACG
1251 TGAATTACAC CTTTGAAATA GAAGCAATGA ATGGAGTTTC TGAGTTGAGT
1301 TTTTCTCCCA AGCCATTCAC AGCTATTACA GTGACCACGG ATCAAGATGC
1351 ACCTTCCCTG ATAGGTGTGG TAAGGAAGGA CTGGGCATCC CAAAATAGCA
1401 TTGCCCTATC ATGGCAAGCA CCTGCTTTTT CCAATGGAGC CATTCTGGAC
1451 TACGAGATCA AGTACTATGA GAAAGAACAT GAGCAGCTGA CCTACTCTTC
1501 CACAAGGTCC AAAGCCCCCA GTGTCATCAT CACAGGTCTT AAGCCAGCCA
1551 CCAAATATGT ATTTCACATC CGAGTGAGAA CTGCGACAGG ATACAGTGGC
1601 TACAGTCAGA AATTTGAATT TGAAACAGGA GATGAAACTT CTGACATGGC
1651 AGCAGAACAA GGACAGATTC TCGTGATAGC CACCGCCGCT GTTGGCGGAT
1701 TCACTCTCCT CGTCATCCTC ACTTTATTCT TCTTGATCAC TGGGAGATGT
1751 CAGTGGTACA TAAAAGCCAA GATGAAGTCA GAAGAGAAGA GAAGAAACCA
1801 CTTACAGAAT GGGCATTTGC GCTTCCCGGG AATTAAAACT TACATTGATC
1851 CAGATACATA TGAAGACCCA TCCCTAGCAG TCCATGAATT TGCAAAGGAG
1901 ATTGATCCCT CAAGAATTCG TATTGAGAGA GTCATTGGGG CAGGTGAATT
1951 TGGAGAAGTC TGTAGTGGGC GTTTGAAGAC ACCAGGGAAA AGAGAGATCC
2001 CAGTTGCCAT TAAAACTTTG AAAGGTGGCC ACATGGATCG GCAAAGAAGA
2051 GATTTTCTAA GAGAAGCTAG TATCATGGGC CAGTTTGACC ATCCAAACAT
2101 CATTCGCCTA GAAGGGGTTG TCACCAAAAG ATCCTTCCCG GCCATTGGGG
2151 TGGAGGCGTT TTGCCCCAGC TTCCTGAGGG CAGGGTTTTT AAATAGCATC
2201 CAGGCCCCGC ATCCAGTGCC AGGGGGAGGA TCTTTGCCCC CCAGGATTCC
2251 TGCTGGCAGA CCAGTAATGA TTGTGGTGGA ATATATGGAG AATGGATCCC
2301 TAGACTCCTT TTTGCGGAAG CATGATGGCC ACTTCACAGT CATCCAGTTG
2351 GTCGGAATGC TCCGAGGCAT TGCATCAGGC ATGAAGTATC TTTCTGATAT
2401 GGGTTATGTT CATCGAGACC TAGCGGCTCG GAATATACTG GTCAATAGCA
2451 ACTTAGTATG CAAAGTTTCT GATTTTGGTC TCTCCAGAGT GCTGGAAGAT
2501 GATCCAGAAG CTGCTTATAC AACAACTGGT GGAAAAATCC CCATAAGGTG
2551 GACAGCCCCA GAAGCCATCG CCTACAGAAA ATTCTCCTCA GCAAGCGATG
2601 CATGGAGCTA TGGCATTGTC ATGTGGGAGG TCATGTCCTA TGGAGAGAGA
2651 CCTTATTGGG AAATGTCTAA CCAAGATGTC ATTCTGTCCA TTGAAGAAGG
2701 GTACAGACTT CCAGCTCCCA TGGGCTGTCC AGCATCTCTA CACCAGCTGA
2751 TGCTCCACTG CTGGCAGAAG GAGAGAAATC ACAGACCAAA ATTTACTGAC
2801 ATTGTCAGCT TCCTTGACAA ACTGATCCGA AATCCCAGTG CCCTTCACAC
2851 CCTGGTGGAG GACATCCTTG TAATGCCAGA GTCCCCTGGT GAAGTTCCGG
2901 AATATCCTTT GCTTGTCACA GTTGGTGACT GGCTAGATTC TATAAAGATG
2951 GGGCAATACA AGAATAACTT CGTGGCAGCA GGGTTTACAA CATTTGACCT
3001 GATTTCAAGA ATGAGCATTG ATGACATTAG AAGAATTGGA GTCATACTTA
3051 TTGGACACCA GAGACGAATA GTCAGTAGCA TACAGACTTT ACGTTTACAC
3101 ATGATGCACA TACAGGAGAA GGGATTTCAT GTATGA (SEQ ID NO:1)
```

FEATURES:
5'UTR: 1-25
Start Codon: 26
Stop Codon: 3134

FIGURE 1A

Homologous proteins:

Top 10 BLAST Hits:

| | Score | E |
|---|---|---|
| gi\|6679661\|ref\|NP_031964.1\| Eph receptor A6 [Mus musculus] >gi\|... | 2089 | 0.0 |
| gi\|1706630\|sp\|P54758\|EPA6_RAT EPHRIN TYPE-A RECEPTOR 6 PRECURSO... | 1907 | 0.0 |
| gi\|125337\|sp\|P29318\|EPA3_CHICK EPHRIN TYPE-A RECEPTOR 3 PRECURS... | 1320 | 0.0 |
| gi\|7434436\|pir\|\|I78843 receptor protein-tyrosine kinase - human... | 1265 | 0.0 |
| gi\|1706628\|sp\|P54756\|EPA5_HUMAN EPHRIN TYPE-A RECEPTOR 5 PRECUR... | 1255 | 0.0 |
| gi\|1083782\|pir\|\|S51604 receptor-like tyrosine kinase Ehk-1 - rat | 1222 | 0.0 |
| gi\|1706629\|sp\|P54757\|EPA5_RAT EPHRIN TYPE-A RECEPTOR 5 PRECURSO... | 1217 | 0.0 |
| gi\|4758288\|ref\|NP_004434.1\| EphB3 [Homo sapiens] >gi\|1708164\|sp... | 1039 | 0.0 |
| gi\|1708165\|sp\|P54754\|EPB3_MOUSE EPHRIN TYPE-B RECEPTOR 3 PRECUR... | 1033 | 0.0 |
| gi\|2137692\|pir\|\|I49071 protein kinase - mouse (fragment) >gi\|59... | 982 | 0.0 |

BLAST to dbEST:

| | Score | E |
|---|---|---|
| gi\|3678806 /dataset=dbest /taxon=9606 ... | 418 | e-114 |
| gi\|7458503 /dataset=dbest /taxon=9606... | 406 | e-110 |
| gi\|7039930 /dataset=dbest /taxon=9606... | 369 | 3e-99 |
| gi\|11323712 /dataset=dbest /taxon=96... | 315 | 3e-83 |
| gi\|6975228 /dataset=dbest /taxon=9606... | 295 | 3e-77 |
| gi\|2162086 /dataset=dbest /taxon=9606 ... | 252 | 4e-64 |

EXPRESSION INFORMATION FOR MODULATORY USE:

library source:

Expression information from BLAST dbEST hits:

gi|3678806 Testis
gi|7458503 Pooled: fetal-lung, testis and B-cell
gi|7039930 Pooled: fetal-lung, testis and B-cell
gi|11323712 Nervous tissue-normal
gi|6975228 Kidney tumors
gi|2162086 Testis Expression information from PCR-based tissue screening panels:

Fetal Brain

FIGURE 1B

```
   1 MGGCEVREFL LQFGFFLPLL TAWPGDCSHV SNNQVVLLDT TTVLGELGWK
  51 TYPLNGWDAI TEMDEHNRPI HTYQVCNVME PNQNNWLRTN WISRDAAQKI
 101 YVEMKFTLRD CNSIPWVLGT CKETFNLFYM ESDESHGIKF KPNQYTKIDT
 151 IAADESFTQM DLGDRILKLN TEIREVGPIE RKGFYLAFQD IGACIALVSV
 201 RVFYKKCPFT VRNLAMFPDT IPRVDSSSLV EVRGSCVKSA EERDTPKLYC
 251 GADGDWLVPL GRCICSTGYE EIEGSCHACR PGFYKAFAGN AKCSKCPPHS
 301 LTYMEATSVC QCEKGYFRAE KDPPSMACTR PPSAPRNVVF NINETALILE
 351 WSPPSDTGGR KDLTYSVICK KCGLDTSQCE DCGGGLRFIP RHTGLINNSV
 401 IVLDFVSHVN YTFEIEAMNG VSELSFSPKP FTAITVTTDQ DAPSLIGVVR
 451 KDWASQNSIA LSWQAPAFSN GAILDYEIKY YEKEHEQLTY SSTRSKAPSV
 501 IITGLKPATK YVFHIRVRTA TGYSGYSQKF EFETGDETSD MAAEQGQILV
 551 IATAAVGGFT LLVILTLFFL ITGRCQWYIK AKMKSEEKRR NHLQNGHLRF
 601 PGIKTYIDPD TYEDPSLAVH EFAKEIDPSR IRIERVIGAG EFGEVCSGRL
 651 KTPGKREIPV AIKTLKGGHM DRQRRDFLRE ASIMGQFDHP NIIRLEGVVT
 701 KRSFPAIGVE AFCPSFLRAG FLNSIQAPHP VPGGGSLPPR IPAGRPVMIV
 751 VEYMENGSLD SFLRKHDGHF TVIQLVGMLR GIASGMKYLS DMGYVHRDLA
 801 ARNILVNSNL VCKVSDFGLS RVLEDDPEAA YTTTGGKIPI RWTAPEAIAY
 851 RKFSSASDAW SYGIVMWEVM SYGERPYWEM SNQDVILSIE EGYRLPAPMG
 901 CPASLHQLML HCWQKERNHR PKFTDIVSFL DKLIRNPSAL HTLVEDILVM
 951 PESPGEVPEY PLLVTVGDWL DSIKMGQYKN NFVAAGFTTF DLISRMSIDD
1001 IRRIGVILIG HQRRIVSSIQ TLRLHMMHIQ EKGFHV (SEQ ID NO:2)
```

FEATURES:

Functional domains and key regions:

[1] PDOC00001 PS00001 ASN_GLYCOSYLATION
N-glycosylation site

Number of matches: 4

| | | |
|---|---|---|
| 1 | 343-346 | NETA |
| 2 | 397-400 | NNSV |
| 3 | 410-413 | NYTF |
| 4 | 756-759 | NGSL |

[2] PDOC00004 PS00004 CAMP_PHOSPHO_SITE
cAMP- and cGMP-dependent protein kinase phosphorylation site 851-854 RKFS

[3] PDOC00005 PS00005 PKC_PHOSPHO_SITE
Protein kinase C phosphorylation site

Number of matches: 14

| | | |
|---|---|---|
| 1 | 107-109 | TLR |
| 2 | 1021-1023 | TLR |
| 3 | 120-122 | TCK |
| 4 | 199-201 | SVR |
| 5 | 210-212 | TVR |
| 6 | 245-247 | TPK |
| 7 | 427-429 | SPK |
| 8 | 492-494 | STR |
| 9 | 527-529 | SQK |
| 10 | 572-574 | TGR |
| 11 | 647-649 | SGR |
| 12 | 664-666 | TLK |
| 13 | 700-702 | TKR |
| 14 | 972-974 | SIK |

FIGURE 2A

```
[4] PDOC00006 PS00006 CK2_PHOSPHO_SITE
Casein kinase II phosphorylation site

Number of matches: 25
      1      61-64 TEMD
      2    107-110 TLRD
      3    120-123 TCKE
      4    146-149 TKID
      5    158-161 TQMD
      6    228-231 SLVE
      7    239-242 SAEE
      8    267-270 TGYE
      9    302-305 TYME
     10    377-380 SQCE
     11    438-441 TDQD
     12    534-537 TGDE
     13    605-608 TYID
     14    611-614 TYED
     15    843-846 TAPE
     16    855-858 SASD
     17    871-874 SYGE
     18    881-884 SNQD
     19    888-891 SIEE
     20    928-931 SFLD
     21    942-945 TLVE
     22    953-956 SPGE
     23    965-968 TVGD
     24    988-991 TTFD
     25   997-1000 SIDD

[5] PDOC00007 PS00007 TYR_PHOSPHO_SITE
Tyrosine kinase phosphorylation site

Number of matches: 3
      1    483-490 KEHEQLTY
      2    604-612 KTYIDPDTY
      3    787-794 KYLSDMGY

[6] PDOC00008 PS00008 MYRISTYL
N-myristoylation site

Number of matches: 11
      1    192-197 GACIAL
      2    274-279 GSCHAC
      3    289-294 GNAKCS
      4    373-378 GLDTSQ
      5    394-399 GLINNS
      6    504-509 GLKPAT
      7    757-762 GSLDSF
      8    777-782 GMLRGI
      9    781-786 GIASGM
     10    900-905 GCPASL
     11    976-981 GQYKNN

[7] PDOC00009 PS00009 AMIDATION
Amidation site

Number of matches: 2
      1    358-361 GGRK
      2    653-656 PGKR
```

FIGURE 2B

[8] PDOC00021 PS01186 EGF_2
EGF-like domain signature 2

263-276 CICSTGYEEIEGSC

[9] PDOC00100 PS00107 PROTEIN_KINASE_ATP
Protein kinases ATP-binding region signature 637-663 IGAGEFGEVCSGRLKTPGKREIPVAIK

[10] PDOC00100 PS00109 PROTEIN_KINASE_TYR
Tyrosine protein kinases specific active-site signature 794-806 YVHRDLAARNILV

[11] PDOC00629 PS00790 RECEPTOR_TYR_KIN_V_1
Receptor tyrosine kinase class V signature 1

188-208 FQDIGACIALVSVRVFYKKCP

[12] PDOC00629 PS00791 RECEPTOR_TYR_KIN_V_2
Receptor tyrosine kinase class V signature 2

250-270 CGADGDWLVPLGRCICSTGYE

<u>Membrane spanning structure and domains:</u>

| Helix | Begin | End | Score | Certainty |
|---|---|---|---|---|
| 1 | 14 | 34 | 1.336 | Certain |
| 2 | 188 | 208 | 0.653 | Putative |
| 3 | 559 | 579 | 2.429 | Certain |
| 4 | 900 | 920 | 0.704 | Putative |

FIGURE 2C

```
BLAST Alignment to Top Hit:
>gi|6679661|ref|NP_031964.1| Eph receptor A6 [Mus musculus]
 sp|Q62413|EPA6_MOUSE EPHRIN TYPE-A RECEPTOR 6 PRECURSOR (TYROSINE-PROTEIN
KINASE RECEPTOR
            EHK-2) (EPH HOMOLOGY KINASE-2)
 gb|AAB53836.1| (U58332) receptor tyrosine kinase [Mus musculus]
          Length = 1035

 Score = 2089 bits (5354), Expect = 0.0
 Identities = 1001/1036 (96%), Positives = 1017/1036 (97%)
 Frame = +1

Query: 28    MGGCEVREFLLQFGFFLPLLTAWPGDCSHVSNNQVVLLDTTTVLGELGWKTYPLNGWDAI 207
             MGGCEVREFLLQFGFFLPLLTAW GDCSHVSN QVVLLDTTTV+GELGWKTYPLNGWDAI
Sbjct: 1     MGGCEVREFLLQFGFFLPLLTAWTGDCSHVSN-QVVLLDTTTVMGELGWKTYPLNGWDAI 59

Query: 208   TEMDEHNRPIHTYQVCNVMEPNQNNWLRTNWISRDAAQKIYVEMKFTLRDCNSIPWVLGT 387
             TEMDEHNRPIHTYQVCNVMEPNQNNWLRTNWISRDAAQKIYVEMKFTLRDCNSIPWVLGT
Sbjct: 60    TEMDEHNRPIHTYQVCNVMEPNQNNWLRTNWISRDAAQKIYVEMKFTLRDCNSIPWVLGT 119

Query: 388   CKETFNLFYMESDESHGIKFKPNQYTKIDTIAADESFTQMDLGDRILKLNTEIREVGPIE 567
             CKETFNL+Y+ESDESHG KFKP+QY KIDTIAADESFTQMDLGDRILKLNTEIREVGPIE
Sbjct: 120   CKETFNLYYIESDESHGTKFKPSQYIKIDTIAADESFTQMDLGDRILKLNTEIREVGPIE 179

Query: 568   RKGFYLAFQDIGACIALVSVRVFYKKCPFTVRNLAMFPDTIPRVDSSSLVEVRGSCVKSA 747
             RKGFYLAFQDIGACIALVSVRVFYKKCPFTVR+LAMFPDTIPRVDSSSLVEVRGSCVKSA
Sbjct: 180   RKGFYLAFQDIGACIALVSVRVFYKKCPFTVRSLAMFPDTIPRVDSSSLVEVRGSCVKSA 239

Query: 748   EERDTPKLYCGADGDWLVPLGRCICSTGYEEIEGSCHACRPGFYKAFAGNAKCSKCPPHS 927
             EERDTPKLYCGADGDWLVPLGRCICSTGYEEIEGSCHACRPGFYKAFAGN KCSKCPPHS
Sbjct: 240   EERDTPKLYCGADGDWLVPLGRCICSTGYEEIEGSCHACRPGFYKAFAGNTKCSKCPPHS 299

Query: 928   LTYMEATSVCQCEKGYFRAEKDPPSMACTRPPSAPRNVVFNINETALILEWSPPSDTGGR 1107
              TY+EATSVC CEKGYFRAEKDPPSMACTRPPSAPRNV FNINETALILEWSPPSDTGGR
Sbjct: 300   STYVEATSVCHCEKGYFRAEKDPPSMACTRPPSAPRNVAFNINETALILEWSPPSDTGGR 359

Query: 1108  KDLTYSVICKKCGLDTSQCEDCGGGLRFIPRHTGLINNSVIVLDFVSHVNYTFEIEAMNG 1287
             KDLTYSVICKKCGLDT+QCEDCGGGLRFIPRHTGLINNSV+VLDFVSHVNYTFEIEAMNG
Sbjct: 360   KDLTYSVICKKCGLDTTQCEDCGGGLRFIPRHTGLINNSVVVLDFVSHVNYTFEIEAMNG 419

Query: 1288  VSELSFSPKPFTAITVTTDQDAPSLIGVVRKDWASQNSIALSWQAPAFSNGAILDYEIKY 1467
             VSELS SPKPFTAITVTTD DAPSLIG++RKDWASQNS+ALSWQAPAFSNGAILDYE KY
Sbjct: 420   VSELSISPKPFTAITVTTDHDAPSLIGMMRKDWASQNSLALSWQAPAFSNGAILDYETKY 479

Query: 1468  YEKEHEQLTYSSTRSKAPSVIITGLKPATKYVFHIRVRTATGYSGYSQKFEFETGDETSD 1647
             YEKEHEQLTYSSTRSKAPSVI+TGLKPAT Y+FHIRVRTATGYSGYSQKFEFETGDETSD
Sbjct: 480   YEKEHEQLTYSSTRSKAPSVIVTGLKPATTYIFHIRVRTATGYSGYSQKFEFETGDETSD 539

Query: 1648  MAAEQGQILVIATAAVGGFTLLVILTLFFLITGRCQWYIKAKMKSEEKRRNHLQNGHLRF 1827
             MAAEQGQILVIATAAVGGFTLLVILTLFFLITGRCQWYIKAKMKSEEKRR HLQNGHLRF
Sbjct: 540   MAAEQGQILVIATAAVGGFTLLVILTLFFLITGRCQWYIKAKMKSEEKRRTHLQNGHLRF 599

Query: 1828  PGIKTYIDPDTYEDPSLAVHEFAKEIDPSRIRIERVIGAGEFGEVCSGRLKTPGKREIPV 2007
             PGIKTYIDPDTYEDPSLAVHEFAKEIDPSRIRIERVIGAGEFGEVCSGRLKTPGKREIPV
Sbjct: 600   PGIKTYIDPDTYEDPSLAVHEFAKEIDPSRIRIERVIGAGEFGEVCSGRLKTPGKREIPV 659

Query: 2008  AIKTLKGGHMDRQRRDFLREASIMGQFDHPNIIRLEGVVTKRSFPAIGVEAFCPSFLRAG 2187
             AIKTLKGGHMDRQRRDFLREASIMGQFDHPNIIRLEGVVTKRSFPAIGVEAFCPSFLRAG
Sbjct: 660   AIKTLKGGHMDRQRRDFLREASIMGQFDHPNIIRLEGVVTKRSFPAIGVEAFCPSFLRAG 719

Query: 2188  FLNSIQAPHPVPGGGSLPPRIPAGRPVMIVVEYMENGSLDSFLRKHDGHFTVIQLVGMLR 2367
             FLN IQAPHPV  GGSLPPRIPAGRPVMIVVEYMENGSLDSFLRKHDGHFTVIQLVGMLR
Sbjct: 720   FLNGIQAPHPVTAGGSLPPRIPAGRPVMIVVEYMENGSLDSFLRKHDGHFTVIQLVGMLR 779

Query: 2368  GIASGMKYLSDMGYVHRDLAARNILVNSNLVCKVSDFGLSRVLEDDPEAAYTTTGGKIPI 2547
             GIASGMKYLSDMGYVHRDLAARNILVNSNLVCKVSDFGLSRVLEDDPEAAYTTTGGKIPI
Sbjct: 780   GIASGMKYLSDMGYVHRDLAARNILVNSNLVCKVSDFGLSRVLEDDPEAAYTTTGGKIPI 839
```

FIGURE 2D

```
Query: 2548  RWTAPEAIAYRKFSSASDAWSYGIVMWEVMSYGERPYWEMSNQDVILSIEEGYRLPAPMG  2727
              RWTAPEAIAYRKFSSASDAWSYGIVMWEVMSYGERPYWEMSNQDVILSIEEGYRLPAPMG
Sbjct:  840  RWTAPEAIAYRKFSSASDAWSYGIVMWEVMSYGERPYWEMSNQDVILSIEEGYRLPAPMG   899

Query: 2728  CPASLHQLMLHCWQKERNHRPKFTDIVSFLDKLIRNPSALHTLVEDILVMPESPGEVPEY   2907
              CP SL QLMLHCWQKERNHRPKFTDIVSFLDKLIRNPSALHTLVEDILVMPESPG+VPEY
Sbjct:  900  CPPSLQQLMLHCWQKERNHRPKFTDIVSFLDKLIRNPSALHTLVEDILVMPESPGDVPEY   959

Query: 2908  PLLVTVGDWLDSIKMGQYKNNFVAAGFTTFDLISRMSIDDIRRIGVILIGHQRRIVSSIQ   3087
              PL VTVGDWLDSIKMGQYK+NF+AAGFTTFDLISRMSIDDIRRIGVILIGHQRRIVSSIQ
Sbjct:  960  PLFVTVGDWLDSIKMGQYKSNFMAAGFTTFDLISRMSIDDIRRIGVILIGHQRRIVSSIQ  1019

Query: 3088  TLRLHMMHIQEKGFHV   3135
              TLRLHMMHIQEKGFHV
Sbjct: 1020  TLRLHMMHIQEKGFHV  1035 (SEQ ID NO:4)

>gi|1706630|sp|P54758|EPA6_RAT EPHRIN TYPE-A RECEPTOR 6 PRECURSOR
            (TYROSINE-PROTEIN KINASE RECEPTOR EHK-2) (EPH HOMOLOGY
            KINASE-2)
  pir||S51605 receptor-like tyrosine kinase Ehk-2 - rat
          Length = 948

  Score = 1907 bits (4885), Expect = 0.0
  Identities = 911/949 (95%), Positives = 927/949 (96%)
  Frame = +1

Query:   28  MGGCEVREFLLQFGFFLPLLTAWPGDCSHVSNNQVVLLDTTTVLGELGWKTYPLNGWDAI    207
              MGGCEVREFLLQFGFFLPLLTAW GDCSHVSN QVVLLDT+TV+GELGWKTYPLNGWDAI
Sbjct:    1  MGGCEVREFLLQFGFFLPLLTAWTGDCSHVSN-QVVLLDTSTVMGELGWKTYPLNGWDAI     59

Query:  208  TEMDEHNRPIHTYQVCNVMEPNQNNWLRTNWISRDAAQKIYVEMKFTLRDCNSIPWVLGT    387
              TEMDEHNRPIHTYQVCNVMEPNQNNWLRTNWISRDAAQKIYVEMKFTLRDCNSIPWVLGT
Sbjct:   60  TEMDEHNRPIHTYQVCNVMEPNQNNWLRTNWISRDAAQKIYVEMKFTLRDCNSIPWVLGT    119

Query:  388  CKETFNLFYMESDESHGIKFKPNQYTKIDTIAADESFTQMDLGDRILKLNTEIREVGPIE    567
              CKETF L+Y+ESDESHG KFKP+QY KIDTIAADESFTQMDLGDRILKLNTE+REVGPIE
Sbjct:  120  CKETFTLYYIESDESHGTKFKPSQYIKIDTIAADESFTQMDLGDRILKLNTEVREVGPIE    179

Query:  568  RKGFYLAFQDIGACIALVSVRVFYKKCPFTVRNLAMFPDTIPRVDSSSLVEVRGSCVKSA    747
              RKGFYLAFQDIGACIALVSVRVFYKKCPFTVRNLAMFPDTIPRVDSSSLVEVRGSCVKS+
Sbjct:  180  RKGFYLAFQDIGACIALVSVRVFYKKCPFTVRNLAMFPDTIPRVDSSSLVEVRGSCVKSS    239

Query:  748  EERDTPKLYCGADGDWLVPLGRCICSTGYEEIEGSCHACRPGFYKAFAGNAKCSKCPPHS    927
              EERDTPKLYCGADGDWLVPLGRCIC+TGYEEIEGSCHACRPGFYKAFAGN KCSKCPPHS
Sbjct:  240  EERDTPKLYCGADGDWLVPLGRCICTTGYEEIEGSCHACRPGFYKAFAGNTKCSKCPPHS    299

Query:  928  LTYMEATSVCQCEKGYFRAEKDPPSMACTRPPSAPRNVVFNINETALILEWSPPSDTGGR   1107
              T++EATSVC CEKGYFRAEKDPPSMACTRPPSAPRNV FNINETALILEWSPPSDTGGR
Sbjct:  300  STFVEATSVCHCEKGYFRAEKDPPSMACTRPPSAPRNVAFNINETALILEWSPPSDTGGR    359

Query: 1108  KDLTYSVICKKCGLDTSQCEDCGGGLRFIPRHTGLINNSVIVLDFVSHVNYTFEIEAMNG   1287
              KDLTYSVICKKCG+D SQCEDCG GLRFIPR TGLINNSV+VLDFVSHVNYTFEIEAMNG
Sbjct:  360  KDLTYSVICKKCGVDASQCEDCGAGLRFIPRPTGLINNSVVVLDFVSHVNYTFEIEAMNG    419

Query: 1288  VSELSFSPKPFTAITVTTDQDAPSLIGVVRKDWASQNSIALSWQAPAFSNGAILDYEIKY   1467
              VSELS SPKPFTAITVTTDQDAPSLIG++RKDWASQNS+ALSWQAPAFSNGAILDYEIKY
Sbjct:  420  VSELSISPKPFTAITVTTDQDAPSLIGMMRKDWASQNSLALSWQAPAFSNGAILDYEIKY    479

Query: 1468  YEKEHEQLTYSSTRSKAPSVIITGLKPATKYVFHIRVRTATGYSGYSQKFEFETGDETSD   1647
              YEKEHEQLTYSSTRSKAPSVIITGLKPAT Y+FHIRVRTATGYSGYSQKFEFETGDETSD
Sbjct:  480  YEKEHEQLTYSSTRSKAPSVIITGLKPATTYIFHIRVRTATGYSGYSQKFEFETGDETSD    539

Query: 1648  MAAEQGQILVIATAAVGGFTLLVILTLFFLITGRCQWYIKAKMKSEEKRRNHLQNGHLRF   1827
              MAAEQGQILVIATAAVGGFTLLVILTLFFLITGRCQWYIKAKMKSEEKRR HLQN HLRF
Sbjct:  540  MAAEQGQILVIATAAVGGFTLLVILTLFFLITGRCQWYIKAKMKSEEKRRTHLQNSHLRF    599

Query: 1828  PGIKTYIDPDTYEDPSLAVHEFAKEIDPSRIRIERVIGAGEFGEVCSGRLKTPGKREIPV   2007
```

FIGURE 2E

```
                 PGIKTYIDPDTYEDPSLAVHEF KEIDPSRIRIERVIGAGEFGEVCSGRLKTPGKREIPV
Sbjct: 600       PGIKTYIDPDTYEDPSLAVHEFEKEIDPSRIRIERVIGAGEFGEVCSGRLKTPGKREIPV 659

Query: 2008      AIKTLKGGHMDRQRRDFLREASIMGQFDHPNIIRLEGVVTKRSFPAIGVEAFCPSFLRAG 2187
                 AIKTLKGGHMDRQRRDFLREASIMGQFDHPNIIRLEGVVTKRSFPAIGVEAFCPSFLRAG
Sbjct: 660       AIKTLKGGHMDRQRRDFLREASIMGQFDHPNIIRLEGVVTKRSFPAIGVEAFCPSFLRAG 719

Query: 2188      FLNSIQAPHPVPGGGSLPPRIPAGRPVMIVVEYMENGSLDSFLRKHDGHFTVIQLVGMLR 2367
                 FLN IQAPHPV  GGSLPPRIPAGRPVMIVVEYMENGSLDSFLRKHDGHFTVIQLVGMLR
Sbjct: 720       FLNGIQAPHPVTAGGSLPPRIPAGRPVMIVVEYMENGSLDSFLRKHDGHFTVIQLVGMLR 779

Query: 2368      GIASGMKYLSDMGYVHRDLAARNILVNSNLVCKVSDFGLSRVLEDDPEAAYTTTGGKIPI 2547
                 GIASGMKYLSDMGYVHRDLAARNILVNSNLVCKVSDFGLSRVLEDDPEAAYTTTGGKIPI
Sbjct: 780       GIASGMKYLSDMGYVHRDLAARNILVNSNLVCKVSDFGLSRVLEDDPEAAYTTTGGKIPI 839

Query: 2548      RWTAPEAIAYRKFSSASDAWSYGIVMWEVMSYGERPYWEMSNQDVILSIEEGYRLPAPMG 2727
                 RWTAPEAIAYRKFSSASD WSYGIVMWEVMSYGERPYWEMSNQDVILSIEEGYRLPAPMG
Sbjct: 840       RWTAPEAIAYRKFSSASDVWSYGIVMWEVMSYGERPYWEMSNQDVILSIEEGYRLPAPMG 899

Query: 2728      CPASLHQLMLHCWQKERNHRPKFTDIVSFLDKLIRNPSALHTLVEDILV 2874
                 CP SLHQLMLHCWQKERNHRPKFTDIVSFLDKLIRNPSALHTLVEDILV
Sbjct: 900       CPPSLHQLMLHCWQKERNHRPKFTDIVSFLDKLIRNPSALHTLVEDILV 948 (SEQ ID NO:5)


>gi|125337|sp|P29318|EPA3_CHICK EPHRIN TYPE-A RECEPTOR 3 PRECURSOR
            (TYROSINE-PROTEIN KINASE RECEPTOR ETK1) (CEK4)
 pir||B45583 receptor tyrosine kinase Cek4 - chicken
 gb|AAA48666.1| (M68514) receptor tyrosine kinase [Gallus gallus]
          Length = 983

 Score = 1320 bits (3378), Expect = 0.0
 Identities = 636/1017 (62%), Positives = 786/1017 (76%), Gaps = 8/1017 (0%)
 Frame = +1

Query: 76        LPLLTAWPGDCSHVS---NNQVVLLDTTTVLGELGWKTYPLNGWDAITEMDEHNRPIHTY 246
                 L LL A  G    +S    N+V LLD+ T+ GELGW +YP +GW+ I+ +DEH  PI TY
Sbjct: 8         LLLLCAALGSAGRLSARPGNEVNLLDSKTIQGELGWISYPSHGWEEISGVDEHYTPIRTY 67

Query: 247       QVCNVMEPNQNNWLRTNWISRDAAQKIYVEMKFTLRDCNSIPWVLGTCKETFNLFYMESD 426
                 Q  NVM+ +QNNWLRTNWI R++AQKIYVE+KFTLRDCNSIP VLGTCKETFNL+YMESD
Sbjct: 68        QESNVMDHSQNNWLRTNWIPRNSAQKIYVELKFTLRDCNSIPLVLGTCKETFNLYYMESD 127

Query: 427       ESHGIKFKPNQYTKIDTIAADESFTQMDLGDRILKLNTEIREVGPIERKGFYLAFQDIGA 606
                 + H  KF+ +Q+TKIDTIAADESFTQMDLGDRILKLNTE+REVGP+ +KGFYLAFQD+GA
Sbjct: 128       DDHLAKFREHQFTKIDTIAADESFTQMDLGDRILKLNTEVREVGPVSKKGFYLAFQDVGA 187

Query: 607       CIALVSVRVFYKKCPFTVRNLAMFPDTIPRVDSSSLVEVRGSCVKSAEERDTPKLYCGAD 786
                 C+ALVSVRV++KKCPFTV+NLAMFPDT+P +DS SLVEVRGSCV  ++E + PK+YC  +
Sbjct: 188       CVALVSVRVYFKKCPFTVKNLAMFPDTVP-MDSQSLVEVRGSCVNHSKEEPPKMYCSTE 246

Query: 787       GDWLVPLGRCICSTGYEEIEGSCHACRPGFYKAFAGNAKCSKCPPHSLTYMEATSVCQCE 966
                 G+WLVP+G+C+C+ GYEE    +C ACRPGFYKA AGN KC+KCPPHS TY +A+  C+CE
Sbjct: 247       GEWLVPIGKCLCNAGYEERGFACQACRPGFYKASAGNVKCAKCPPHSSTYEDASLNCRCE 306

Query: 967       KGYFRAEKDPPSMACTRPPSAPRNVVFNINETALILEWSPPSDTGGRKDLTYSVICKKCG 1146
                 K YFR+EKDPPSMACTRPPSAPRNV+ NINET++IL+WS P DTGGRKD+T+++ICKKCG
Sbjct: 307       KNYFRSEKDPPSMACTRPPSAPRNVISNINETSVILDWSWPLDTGGRKDVTFNIICKKCG 366

Query: 1147      LDTSQCEDCGGGLRFIPRHTGLINNSVIVLDFVSHVNYTFEIEAMNGVSELSFSPKPFTA 1326
                   +  CE C   +RF+PR TGL N +V V+D ++H NYTFEI+A+NGVS+LS    + F A
Sbjct: 367       GSSKICEPCSDNVRFLPRQTGLTNTTVTVVDLLAHTNYTFEIDAVNGVSDLSTLSRQFAA 426

Query: 1327      ITVTTDQDAPSLIGVVRKDWASQNSIALSWQAPAFSNGAILDYEIKYYEKEHEQLTYSST 1506
                 +++TT+Q APS I V+RKD  S+NS++LSWQ P   NG ILDYE+KYYEK+ ++ +Y+
Sbjct: 427       VSITTNQAAPSPITVIRKDRTSRNSVSLSWQEPEHPNGIILDYEVKYYEKQEQETSYTIL 486

Query: 1507      RSKAPSVIITGLKPATKYVFHIRVRTATGYSGYSQKFEFETGDETSDMAAEQGQILVIAT 1686
                 R+K+ +V I+GLKP T YVF IR RTA  Y   S+KFEFET ++ +++E  Q+++IA
```

FIGURE 2F

```
Sbjct: 487  RAKSTNVTISGLKPDTTYVFQIRARTAARYGTSSRKFEFETSPDSFSISSENSQVVMIAI 546

Query: 1687 AAVGGFTLLVILTLFFLITGRCQWYIKAKMKSEEKRRNHLQNGHLRFPGIKTYIDPDTYE 1866
            +A     LL ++    +++ GR    Y K+K  ++EKR  H  NGHL+ PG++TY+DP TYE
Sbjct: 547  SAAVAIILLTVVV--YVLIGRFCGYKKSKHGTDEKRL-HFGNGHLKLPGLRTYVDPHTYE 603

Query: 1867 DPSLAVHEFAKEIDPSRIRIERVIGAGEFGEVCSGRLKTPGKREIPVAIKTLKGGHMDRQ 2046
            DP+ AVHEFAKE+D S I I++V+GAGEFGEVCSGRLK P K+EI VAIKTLK G+ ++Q
Sbjct: 604  DPNQAVHEFAKELDASNISIDKVVGAGEFGEVCSGRLKLPSKKEISVAIKTLKAGYTEKQ 663

Query: 2047 RRDFLREASIMGQFDHPNIIRLEGVVTKRSFPAIGVEAFCPSFLRAGFLNSIQAPHPVPG 2226
            RRDFL EASIMGQFDHPNIIRLEGVVTK
Sbjct: 664  RRDFLGEASIMGQFDHPNIIRLEGVVTK-------------------------------- 691

Query: 2227 GGSLPPRIPAGRPVMIVVEYMENGSLDSFLRKHDGHFTVIQLVGMLRGIASGMKYLSDMG 2406
                       +PVMIV EYMENGSLDSFLRKHD  FTVIQLVGMLRGIASGMKYLSDMG
Sbjct: 692  ----------SKPVMIVTEYMENGSLDSFLRKHDAQFTVIQLVGMLRGIASGMKYLSDMG 741

Query: 2407 YVHRDLAARNILVNSNLVCKVSDFGLSRVLEDDPEAAYTTTGGKIPIRWTAPEAIAYRKF 2586
            YVHRDLAARNIL+NSNLVCKVSDFGLSRVLEDDPEAAYTT GGKIPIRWT+PEAIAYRKF
Sbjct: 742  YVHRDLAARNILINSNLVCKVSDFGLSRVLEDDPEAAYTTRGGKIPIRWTSPEAIAYRKF 801

Query: 2587 SSASDAWSYGIVMWEVMSYGERPYWEMSNQDVILSIEEGYRLPAPMGCPASLHQLMLHCW 2766
            +SASDAWSYGIV+WEVMSYGERPYWEMS QDVI +++EGYRLP PM CPA+L+QLML CW
Sbjct: 802  TSASDAWSYGIVLWEVMSYGERPYWEMSFQDVIKAVDEGYRLPPPMDCPAALYQLMLDCW 861

Query: 2767 QKERNHRPKFTDIVSFLDKLIRNPSALHTLVE-----DILVMPESPGEVPEYPLLVTVGD 2931
            QK+RN+RPKF  IVS LDKLIRNPS+L  +          L++ +S  ++  +    T GD
Sbjct: 862  QKDRNNRPKFEQIVSILDKLIRNPSSLKIITNAAARPSNLLLDQSNIDISAFR---TAGD 918

Query: 2932 WLDSIKMGQYKNNFVAAGFTTFDLISRMSIDDIRRIGVILIGHQRRIVSSIQTLRLH 3102
            WL+  + GQ K  F    +++ D I+++S DD++++GV ++G Q++IVSSI+TL  H
Sbjct: 919  WLNGFRTGQCKGIFTGVEYSSCDTIAKISTDDMKKVGVTVVGPQKKIVSSIKTLETH 975
(SEQ ID NO:6)

>gi|7434436|pir||I78843 receptor protein-tyrosine kinase - human
          (fragment)
 gb|AAA74245.1| (L36644) receptor protein-tyrosine kinase [Homo sapiens]
          Length = 991

 Score = 1265 bits (3237), Expect = 0.0
 Identities = 604/1002 (60%), Positives = 766/1002 (76%), Gaps = 5/1002 (0%)
 Frame = +1

Query: 121  NNQVVLLDTTTVLGELGWKTYPLNGWDAITEMDEHNRPIHTYQVCNVMEPNQNNWLRTNW 300
            +N+V LLD+ TV+G+LGW  +P NGW+ I E+DE+  PIHTYQVC VME NQNNWL T+W
Sbjct: 34   SNEVNLLDSRTVMGDLGWIAFPKNGWEEIGEVDENYAPIHTYQVCKVMEQNQNNWLLTSW 93

Query: 301  ISRDAAQKIYVEMKFTLRDCNSIPWVLGTCKETFNLFYMESDESHGIKFKPNQYTKIDTI 480
            IS + A +I++E+KFTLRDCNS+P  LGTCKETFN++Y ESD+ +G   K NQY KIDTI
Sbjct: 94   ISNEGASRIFIELKFTLRDCNSLPGGLGTCKETFNMYYFESDDQNGRNIKENQYIKIDTI 153

Query: 481  AADESFTQMDLGDRILKLNTEIREVGPIERKGFYLAFQDIGACIALVSVRVFYKKCPFTV 660
            AADESFT++DLGDR++KLNTE+R+VGP+ +KGFYLAFQD+GACIALVSVRV+YKKCP  V
Sbjct: 154  AADESFTELDLGDRVMKLNTEVRDVGPLSKKGFYLAFQDVGACIALVSVRVYYKKCPSVV 213

Query: 661  RNLAMFPDTIPRVDSSSLVEVRGSCVKSAEERDTPKLYCGADGDWLVPLGRCICSTGYEE 840
            R+LA+FPDTI   DSS L+EV GSCV  +    + PK++C A+G+WLVP+G+C+C  GYEE
Sbjct: 214  RHLAVFPDTITGADSSQLLEVSGSCVNHSVTDEPPKMHCSAEGEWLVPIGKCMCKAGYEE 273

Query: 841  IEGSCHACRPGFYKAFAGNAKCSKCPPHSLTYMEATSVCQCEKGYFRAEKDPPSMACTRP 1020
              G+C  CRPGF+KA        C KCPPHS T+ EA++ C CEK YFR E DPP+MACTRP
Sbjct: 274  KNGTCQVCRPGFFKASPHIQSCGKCPPHSYTHEEASTSCVCEKDYFRRESDPPTMACTRP 333

Query: 1021 PSAPRNVVFNINETALILEWSPPSDTGGRKDLTYSVICKKCGLDTSQCEDCGGGLRFIPR 1200
            PSAPRN + N+NET++ LEW PP+DTGGRKD++Y + CKKC        CE+CGG +R++PR
Sbjct: 334  PSAPRNAISNVNETSVFLEWIPPADTGGRKDVSYYIACKKCNSHAGVCEECGGHVRYLPR 393
```

FIGURE 2G

```
Query: 1201 HTGLINNSVIVLDFVSHVNYTFEIEAMNGVSELSFSPKPFTAITVTTDQDAPSLIGVVRK 1380
             +GL N SV+++D ++H NYTFEIEA+NGVS+LS    + + ++ VTT+Q APS +  V+K
Sbjct: 394  QSGLKNTSVMMVDLLAHTNYTFEIEAVNGVSDLSPGARQYVSVNVTTNQAAPSPVTNVKK 453

Query: 1381 DWASQNSIALSWQAPAFSNGAILDYEIKYYEKEHEQLTYSSTRSKAPSVIITGLKPATKY 1560
               ++NSI+LSWQ P   NG IL+YEIK++EK+ E  +Y+  +SK  ++    GLKPA+ Y
Sbjct: 454  GKIAKNSISLSWQEPDRPNGIILEYEIKHFEKDQE-TSYTIIKSKETTITAEGLKPASVY 512

Query: 1561 VFHIRVRTATGYSGYSQKFEFETGDETSDMAAEQGQILVIATAAVGGFTLLVILTLFFLI 1740
            VF IR RTA GY  +S++FEFET        +++Q QI VIA +   G  LL ++ +  L+
Sbjct: 513  VFQIRARTAAGYGVFSRRFEFET-TPVFAASSDQSQIPVIAVSVTVGVILLAVV-IGVLL 570

Query: 1741 TGRCQWYIKAKMKSEEKRRNHLQNGHLRFPGIKTYIDPDTYEDPSLAVHEFAKEIDPSRI 1920
            +GR   Y KAK   EE++  H  NGH++ PG++TYIDP TYEDP+ AVHEFAKEI+ S I
Sbjct: 571  SGRRCGYSKAKQDPEEEKM-HFHNGHIKLPGVRTYIDPHTYEDPNQAVHEFAKEIEASCI 629

Query: 1921 RIERVIGAGEFGEVCSGRLKTPGKREIPVAIKTLKGGHMDRQRRDFLREASIMGQFDHPN 2100
             IERVIGAGEFGEVCSGRLK PGKRE+PVAIKTLK G+ ++QRRDFL EASIMGQFDHPN
Sbjct: 630  TIERVIGAGEFGEVCSGRLKLPGKRELPVAIKTLKVGYTEKQRRDFLGEASIMGQFDHPN 689

Query: 2101 IIRLEGVVTKRSFPAIGVEAFCPSFLRAGFLNSIQAPHPVPGGGSLPPRIPAGRPVMIVV 2280
            II LEGVVTK                                            +PVMIV
Sbjct: 690  IIHLEGVVTK--------------------------------------------SKPVMIVT 707

Query: 2281 EYMENGSLDSFLRKHDGHFTVIQLVGMLRGIASGMKYLSDMGYVHRDLAARNILVNSNLV 2460
            EYMENGSLD+FL+K+DG FTVIQLVGMLRGI++GMKYLSDMGYVHRDLAARNIL+NSNLV
Sbjct: 708  EYMENGSLDTFLKKNDGQFTVIQLVGMLRGISAGMKYLSDMGYVHRDLAARNILINSNLV 767

Query: 2461 CKVSDFGLSRVLEDDPEAAYTTTGGKIPIRWTAPEAIAYRKFSSASDAWSYGIVMWEVMS 2640
            CKVSDFGLSRVLEDDPEAAYTT GGKIPIRWTAPEAIA+RKF+SASD WSYGIVMWEV+S
Sbjct: 768  CKVSDFGLSRVLEDDPEAAYTTRGGKIPIRWTAPEAIAFRKFTSASDVWSYGIVMWEVVS 827

Query: 2641 YGERPYWEMSNQDVILSIEEGYRLPAPMGCPASLHQLMLHCWQKERNHRPKFTDIVSFLD 2820
            YGERPYWEM+NQDVI ++EEGYRLP+PM CPA+L+QLML CWQKERN RPKF +IV+ LD
Sbjct: 828  YGERPYWEMTNQDVIKAVEEGYRLPSPMDCPAALYQLMLDCWQKERNSRPKFDEIVNMLD 887

Query: 2821 KLIRNPSALHTLVE-----DILVMPESPGEVPEYPLLVTVGDWLDSIKMGQYKNNFVAAG 2985
            KLIRNPS+L TLV        L+   SP       Y    +VG+WL++IKMG+Y   F+  G
Sbjct: 888  KLIRNPSSLKTLVNASCRVSNLLAEHSPLGSGAYR---SVGEWLEAIKMGRYTEIFMENG 944

Query: 2986 FTTFDLISRMSIDDIRRIGVILIGHQRRIVSSIQTLRLHMMH 3111
            +++ D +++++++D+RR+GV L+GHQ++I++S+Q +++ +++
Sbjct: 945  YSSMDAVAQVTLEDLRRLGVTLVGHQKKIMNSLQEMKVQLVN 986 (SEQ ID NO:7)


>gi|1706628|sp|P54756|EPA5_HUMAN EPHRIN TYPE-A RECEPTOR 5 PRECURSOR
          (TYROSINE-PROTEIN KINASE RECEPTOR EHK-1) (EPH HOMOLOGY
          KINASE-1) (RECEPTOR PROTEIN-TYROSINE KINASE HEK7)
 emb|CAA64700.1| (X95425) EHK-1 receptor tyrosine kinase [Homo sapiens]
          Length = 1037

 Score = 1255 bits (3212), Expect = 0.0
 Identities = 605/1024 (59%), Positives = 767/1024 (74%), Gaps = 27/1024 (2%)
 Frame = +1

Query: 121  NNQVVLLDTTTVLGELGWKTYPLNGWDAITEMDEHNRPIHTYQVCNVMEPNQNNWLRTNW 300
            +N+V LLD+ TV+G+LGW  +P NGW+ I E+DE+  PIHTYQVC VME NQNNWL T+W
Sbjct: 58   SNEVNLLDSRTVMGDLGWIAFPKNGWEEIGEVDENYAPIHTYQVCKVMEQNQNNWLLTSW 117

Query: 301  ISRDAAQKIYVEMKFTLRDCNSIPWVLGTCKETFNLFYMESDESHGIKFKPNQYTKIDTI 480
            IS + A +I++E+KFTLRDCNS+P  LGTCKETFN++Y ESD+ +G   K NQY KIDTI
Sbjct: 118  ISNEGASRIFIELKFTLRDCNSLPGGLGTCKETFNMYYFESDDQNGRNIKENQYIKIDTI 177

Query: 481  AADESFTQMDLGDRILKLNTEIREVGPIERKGFYLAFQDIGACIALVSVRVFYKKCPFTV 660
            AADESFT++DLGDR++KLNTE+R+VGP+ +KGFYLAFQD+GACIALVSVRV+YKKCP  V
Sbjct: 178  AADESFTELDLGDRVMKLNTEVRDVGPLSKKGFYLAFQDVGACIALVSVRVYYKKCPSVV 237

Query: 661  RNLAMFPDTIPRVDSSSLVEVRGSCVKSAEERDTPKLYCGADGDWLVPLGRCICSTGYEE 840
```

FIGURE 2H

```
              R+LA+FPDTI   DSS L+EV GSCV  +    + PK++C A+G+WLVP+G+C+C  GYEE
Sbjct: 238    RHLAVFPDTITGADSSQLLEVSGSCVNHSVTDEPPKMHCSAEGEWLVPIGKCMCKAGYEE 297

Query: 841    IEGSCHACRPGFYKAFAGNAKCSKCPPHSLTYMEATSVCQCEKGYFRAEKDPPSMACTRP 1020
               G+C  CRPGF+KA         C KCPPHS T+ EA++ C CEK YFR E DPP+MACTRP
Sbjct: 298    KNGTCQVCRPGFFKASPHIQSCGKCPPHSYTHEEASTSCVCEKDYFRRESDPPTMACTRP 357

Query: 1021   PSAPRNVVFNINETALILEWSPPSDTGGRKDLTYSVICKKCGLDTSQCEDCGGGLRFIPR 1200
              PSAPRN + N+NET++ LEW PP+DTGGRKD++Y + CKKC       CE+CGG +R++PR
Sbjct: 358    PSAPRNAISNVNETSVFLEWIPPADTGGRKDVSYYIACKKCNSHAGVCEECGGHVRYLPR 417

Query: 1201   HTGLINNSVIVLDFVSHVNYTFEIEAMNGVSELSFSPKPFTAITVTTDQDAPSLIGVVRK 1380
               +GL N SV+++D ++H NYTFEIEA+NGVS+LS    + + ++ VTT+Q APS +   V+K
Sbjct: 418    QSGLKNTSVMMVDLLAHTNYTFEIEAVNGVSDLSPGARQYVSVNVTTNQAAPSPVTNVKK 477

Query: 1381   DWASQNSIALSWQAPAFSNGAILDYEIKYYEKEHEQLTYSSTRSKAPSVIITGLKPATKY 1560
                  ++NSI+LSWQ P   NG IL+YEIK++EK+ E  +Y+  +SK  ++   GLKPA+ Y
Sbjct: 478    GKIAKNSISLSWQEPDRPNGIILEYEIKHFEKDQE-TSYTIIKSKETTITAEGLKPASVY 536

Query: 1561   VFHIRVRTATGYSGYSQKFEFETGDETSDMAAEQGQILVIATAAVGGFTLLVILTLFFLI 1740
              VF IR RTA GY  +S++FEFET         +++Q QI VIA +    G  LL ++ +  L+
Sbjct: 537    VFQIRARTAAGYGVFSRRFEFET-TPVFAASSDQSQIPVIAVSVTVGVILLAVV-IGVLL 594

Query: 1741   TGRC-------------------QW---YIKAKMKSEEKRRNHLQNGHLRFPGIKTYIDP 1854
              +G C                    W   Y KAK   EE++  H  NGH++ PG++TYIDP
Sbjct: 595    SGSCCECGCGRASSLCAVAHPILIWRCGYSKAKQDPEEEKM-HFHNGHIKLPGVRTYIDP 653

Query: 1855   DTYEDPSLAVHEFAKEIDPSRIRIERVIGAGEFGEVCSGRLKTPGKREIPVAIKTLKGGH 2034
               TYEDP+ AVHEFAKEI+ S I IERVIGAGEFGEVCSGRLK PGKRE+PVAIKTLK G+
Sbjct: 654    HTYEDPNQAVHEFAKEIEASCITIERVIGAGEFGEVCSGRLKLPGKRELPVAIKTLKVGY 713

Query: 2035   MDRQRRDFLREASIMGQFDHPNIIRLEGVVTKRSFPAIGVEAFCPSFLRAGFLNSIQAPH 2214
               ++QRRDFL EASIMGQFDHPNII LEGVVTK
Sbjct: 714    TEKQRRDFLGEASIMGQFDHPNIIHLEGVVTK---------------------------- 745

Query: 2215   PVPGGGSLPPRIPAGRPVMIVVEYMENGSLDSFLRKHDGHFTVIQLVGMLRGIASGMKYL 2394
                              +PVMIV EYMENGSLD+FL+K+DG FTVIQLVGMLRGI++GMKYL
Sbjct: 746    --------------SKPVMIVTEYMENGSLDTFLKKNDGQFTVIQLVGMLRGISAGMKYL 791

Query: 2395   SDMGYVHRDLAARNILVNSNLVCKVSDFGLSRVLEDDPEAAYTTTGGKIPIRWTAPEAIA 2574
              SDMGYVHRDLAARNIL+NSNLVCKVSDFGLSRVLEDDPEAAYTT GGKIPIRWTAPEAIA
Sbjct: 792    SDMGYVHRDLAARNILINSNLVCKVSDFGLSRVLEDDPEAAYTTRGGKIPIRWTAPEAIA 851

Query: 2575   YRKFSSASDAWSYGIVMWEVMSYGERPYWEMSNQDVILSIEEGYRLPAPMGCPASLHQLM 2754
              +RKF+SASD WSYGIVMWEV+SYGERPYWEM+NQDVI ++EEGYRLP+PM CPA+L+QLM
Sbjct: 852    FRKFTSASDVWSYGIVMWEVVSYGERPYWEMTNQDVIKAVEEGYRLPSPMDCPAALYQLM 911

Query: 2755   LHCWQKERNHRPKFTDIVSFLDKLIRNPSALHTLVE-----DILVMPESPGEVPEYPLLV 2919
              L CWQKERN RPKF +IV+ LDKLIRNPS+L TLV          L+  SP      Y
Sbjct: 912    LDCWQKERNSRPKFDEIVNMLDKLIRNPSSLKTLVNASCRVSNLLAEHSPLGSGAYR--- 968

Query: 2920   TVGDWLDSIKMGQYKNNFVAAGFTTFDLISRMSIDDIRRIGVILIGHQRRIVSSIQTLRL 3099
              +VG+WL++IKMG+Y    F+   G+++ D  +++++++D+RR+GV L+GHQ++I++S+Q +++
Sbjct: 969    SVGEWLEAIKMGRYTEIFMENGYSSMDAVAQVTLEDLRRLGVTLVGHQKKIMNSLQEMKV 1028

Query: 3100   HMMH 3111
               +++
Sbjct: 1029   QLVN 1032 (SEQ ID NO:8)
```

Hmmer search results (Pfam):

| Model | Description | Score | E-value | N |
|---|---|---|---|---|
| CE00202 | CE00202 EPHRIN_TYPE_A_RECEPTOR | 2982.0 | 0 | 1 |
| CE00201 | CE00201 EPHRIN_TYPE_B_RECEPTOR | 1674.9 | 0 | 4 |
| CE00287 | CE00287 PTK_Eph_orphan_receptor | 696.0 | 1.7e-205 | 1 |
| PF01404 | Ephrin receptor ligand binding domain | 474.1 | 5.9e-140 | 1 |
| PF00069 | Eukaryotic protein kinase domain | 249.6 | 4.4e-71 | 1 |
| CE00290 | CE00290 PTK_Trk_family | 229.5 | 4.9e-65 | 1 |

FIGURE 2I

| | | | | |
|---|---|---|---|---|
| CE00292 | CE00292 PTK_membrane_span | 185.5 | 8.3e-52 | 1 |
| CE00286 | E00286 PTK_EGF_receptor | 165.6 | 8.3e-46 | 1 |
| CE00334 | E00334 urotrophin_receptor | 154.6 | 1.2e-48 | 2 |
| CE00203 | CE00203 ERBB_RECEPTOR | 120.4 | 4.1e-33 | 2 |
| CE00291 | CE00291 PTK_fgf_receptor | 110.5 | 3.3e-29 | 1 |
| CE00031 | CE00031 VEGFR | 110.0 | 5e-33 | 1 |
| PF00041 | Fibronectin type III domain | 91.3 | 6.6e-25 | 2 |
| CE00549 | CE00549 NGFR | 91.0 | 3.4e-26 | 2 |
| PF00536 | SAM domain (Sterile alpha motif) | 77.9 | 6.4e-21 | 1 |
| CE00204 | CE00204 FIBROBLAST_GROWTH_RECEPTOR | 58.3 | 1.7e-15 | 1 |
| CE00288 | CE00288 PTK_Insulin_receptor | 43.7 | 4.3e-22 | 1 |
| CE00359 | E00359 bone_morphogenetic_protein_receptor | 35.3 | 2.8e-09 | 1 |
| CE00220 | E00220 ACTIVIN_RECEPTOR | 15.2 | 0.00077 | 1 |
| PF00020 | TNFR/NGFR cysteine-rich region | 10.1 | 0.14 | 1 |
| CE00030 | CE00030 TRAIL_receptor | 5.2 | 0.78 | 1 |
| PF01683 | EB module | 5.0 | 7 | 1 |
| PF00201 | UDP-glucoronosyl and UDP-glucosyl transferas | 4.2 | 2.1 | 1 |
| CE00278 | CE00278 dynorphin | 2.5 | 9.6 | 1 |
| CE00289 | CE00289 PTK_PDGF_receptor | -69.7 | 0.6 | 1 |
| CE00016 | CE00016 GSK_glycogen_synthase_kinase | -292.1 | 1.6 | 1 |

Parsed for domains:

| Model | Domain | seq-f | seq-t | | hmm-f | hmm-t | | score | E-value |
|---|---|---|---|---|---|---|---|---|---|
| PF01404 | 1/1 | 34 | 207 | .. | 1 | 178 | [] | 474.1 | 5.9e-140 |
| PF01683 | 1/1 | 261 | 276 | .. | 41 | 56 | .] | 5.0 | 7 |
| PF00020 | 1/1 | 279 | 310 | .. | 1 | 42 | [] | 10.1 | 0.14 |
| CE00030 | 1/1 | 309 | 326 | .. | 148 | 164 | .. | 5.2 | 0.78 |
| PF00041 | 1/2 | 332 | 425 | .. | 1 | 84 | [] | 31.6 | 1.1e-07 |
| PF00041 | 2/2 | 440 | 527 | .. | 1 | 84 | [] | 59.6 | 9.4e-16 |
| CE00201 | 1/4 | 37 | 564 | .. | 41 | 590 | .. | 756.6 | 1.1e-223 |
| PF00201 | 1/1 | 556 | 590 | .. | 473 | 507 | .] | 4.2 | 2.1 |
| CE00278 | 1/1 | 578 | 598 | .. | 149 | 169 | .] | 2.5 | 9.6 |
| CE00203 | 1/2 | 658 | 698 | .. | 768 | 808 | .. | 5.1 | 0.45 |
| CE00334 | 1/2 | 622 | 700 | .. | 531 | 610 | .. | 10.5 | 0.0027 |
| CE00201 | 2/4 | 601 | 701 | .. | 626 | 726 | .. | 248.8 | 7.3e-71 |
| CE00289 | 1/1 | 628 | 724 | .. | 1 | 109 | [] | -69.7 | 0.6 |
| CE00220 | 1/1 | 796 | 819 | .. | 342 | 365 | .. | 15.2 | 0.00077 |
| CE00549 | 1/2 | 782 | 821 | .. | 692 | 731 | .. | 35.8 | 4e-10 |
| CE00359 | 1/1 | 749 | 871 | .. | 219 | 357 | .. | 35.3 | 2.8e-09 |
| CE00204 | 1/1 | 796 | 877 | .. | 660 | 740 | .. | 58.3 | 1.7e-15 |
| CE00549 | 2/2 | 839 | 916 | .. | 748 | 825 | .. | 54.4 | 1.5e-15 |
| PF00069 | 1/1 | 631 | 927 | .. | 1 | 273 | [. | 249.6 | 4.4e-71 |
| CE00203 | 2/2 | 782 | 928 | .. | 849 | 994 | .. | 115.3 | 1e-31 |
| CE00290 | 1/1 | 631 | 930 | .. | 1 | 282 | [] | 229.5 | 4.9e-65 |
| CE00291 | 1/1 | 631 | 930 | .. | 1 | 285 | [] | 110.5 | 3.3e-29 |
| CE00292 | 1/1 | 631 | 930 | .. | 1 | 288 | [] | 185.5 | 8.3e-52 |
| CE00288 | 1/1 | 631 | 930 | .. | 1 | 269 | [] | 43.7 | 4.3e-22 |
| CE00287 | 1/1 | 631 | 930 | .. | 1 | 260 | [] | 696.0 | 1.7e-205 |
| CE00286 | 1/1 | 631 | 930 | .. | 1 | 263 | [] | 165.6 | 8.3e-46 |
| CE00334 | 2/2 | 746 | 933 | .. | 614 | 816 | .. | 144.0 | 2.5e-45 |
| CE00031 | 1/1 | 782 | 934 | .. | 1055 | 1207 | .. | 110.0 | 5e-33 |
| CE00201 | 3/4 | 745 | 940 | .. | 728 | 925 | .. | 550.2 | 1.4e-161 |
| CE00016 | 1/1 | 521 | 999 | .. | 1 | 433 | [] | -292.1 | 1.6 |
| PF00536 | 1/1 | 959 | 1023 | .. | 1 | 67 | [] | 77.9 | 6.4e-21 |
| CE00201 | 4/4 | 957 | 1034 | .. | 944 | 1021 | .] | 116.6 | 3.7e-31 |
| CE00202 | 1/1 | 16 | 1036 | .] | 1 | 1087 | [] | 2982.0 | 0 |

FIGURE 2J

1 ATGATGTTGG AAATACTAGT AACAAATAAA GTATCACGGA AATCCCCACC
51 CAAGCGATAC GGTTTCCTTG ACGCGCCCTT AACCAAGGCG TTAAGTTTAG
101 CCTGACAGCA TCCCTCCCTC CTTTCGGTTC CTGGCCTGAT GAGCCGCCTC
151 CACCTGCGAG CGGTGCAGGC ATTTTTGTTG TCGACTAACC CCCTCTAGCG
201 CCGAACTGGC GGCATCCGAG CCGCGGCTGC CAGGCCGGGA GAAGGCTGGG
251 CTTGGCCGGG CTCTGCAGCG CTCCGGGCTC CGTCCCTGCC CTGGGCGCCC
301 GCCTCCGCCG CGGGGCGAGG TGGTGGAGAC CGCGGACGCC GAGGGTCCTC
351 CCAGTCAGCA CGCCGCGTTG CCCCGGCCTG GGGCGGGGGC CGCGGAGTCC
401 CACCAAGTGG CCCGCGCTNN NNNNNNNNNN NNNNNNNNNN NNNNNNNNNN
451 NNNNNNNNNN NNNNNNNNNN NNNNNNNNNN NNNNNNNNNN NNNNNNNNNN
501 NNNNNNNNNN NNNNNNNNNN NNNNNNNNNN NNNNNNNNNN NNNNNNNNNN
551 NNNNNNNNNN NNNNNNNNNN NNNNNNNNNN NNNNNNNNNN NNNNNNNNNN
601 NNNNNNNNNN NNNNNNNNNN NNNNNNNNNN NNNNNNNNNN NNNNNNNNNN
651 NNNNNNNNNN NNNNNNNNNN NNNNNNNNNN NNNNNNNNNN NNNNNNNNNN
701 NNNNNNNNNN NNNNNNNNNN NNNNNNNNNN NNNNNNNNNN NNNNNNNNNN
751 NNNNNNNNNN NNNNNNNNNN NNNNNNNNNN NNNNNNNNNN NNNNNNNNNN
801 NNNNNNNNNN NNNNNNNNNN NNNNNNNNNN NNNNNNNNNN NNNNNNNNNN
851 NNNNNNNNNN NNNNNNNNNN NNNNNNNNNN NNNNNNNNNN NNNNNNNNNN
901 NNNNNNNNNN NNNNNNNNNN NNNNNNNNNN NNNNNNNNNN NNNNNNNNNN
951 NNNNNNNNNN NNNNNNNNNN NNNNNNNNNN NNNNNNNNNN NNNNNNNNNN
1001 NNNNNNNNNN NNNNNNNNNN NNNNNNNNNN NNNNNNNNNN NNNNNNNNNN
1051 NNNNNNNNNN NNNNNNNNNN NNNNNNNNNN NNNNNNNNNN NNNNNNNNNN
1101 NNNNNNNNNN NNNNNNNNNN NNNNNNNNNN NNNNNNNNNN NNNNNNNNNN
1151 NNNNNNNNNN NNNNNNNNNN NNNNNNNNNN NNNNNNNNNN NNNNNNNNNN
1201 NNNNNNNNNN NNNNNNNNNN NNNNNNNNNN NNNNNNNNNN NNNNNNNNNN
1251 NNNNNNNNNN NNNNNNNNNN NNNNNNNNNN NNNNNNNNNN NNNNNNNNNN
1301 NNNNNNNNNN NNNNNNNNNN NNNNNNNNNN NNNNNNNNNN NNNNNNNNNN
1351 NNNNNNNNNN NNNNNNNNNN NNNNNNNNNN NNNNNNNNNN NNNNNNNNNN
1401 NNNNNNNNNN NNNNNNNNNN NNNNNNNNNN NNNNNNNNNN NNNNNNNNNN
1451 NNNNNNNNNN NNNNNNNNNN NNNNNNNNNN NNNNNNNNNN NNNNNNNNNN
1501 NNNNNNNNNN NNNNNNNNNN NNNNNNNNNN NNNNNNNNNN NNNNNNNNNN
1551 NNNNNNNNNN NNNNNNNNNN NNNNNNNNNN NNNNNNNNNN NNNNNNNNNN
1601 NNNNNNNNNN NNNNNNNNNN NNNNNNNNNN NNNNNNNNNN NNNNNNNNNN
1651 NNNNNNNNNN NNNNNNNNNN NNNNNNNNNN NNNNNNNNNN NNNNNNNNNN
1701 NNNNNNNNNN NNNNNNNNNN NNNNNNNNNN NNNNNNNNNN NNNNNNNNNN
1751 NNNNNNNNNN NNNNNNNNNN NNNNNNNNNN NNNNNNNNNN NNNNNNNNNN
1801 NNNNNNNNNN NNNCTGCACC TGCAACTGGG CAGCCTGGAC CCTCGTGCCC
1851 TGTTCCCGGG ACCTCGCGCA GGGGGCGCCC CGGGACACCC CCTGCGGGCC
1901 GGGTGGAGGA GGAAGAGGAG GAGGAGGAAG AAGACGTGGA CAAGGACCCC
1951 CATCCTACCC AGAACACCTG CCTGCGCTGC CGCCACTTCT CTTTAAGGGA
2001 GAGGAAAAGA GAGCCTAGGA GAACCATGGG GGGCTGCGAA GTCCGGGAAT
2051 TTCTTTTGCA ATTTGGTTTC TTCTTGCCTC TGCTGACAGC GTGGCCAGGC
2101 GACTGCAGTC ACGTCTCCAA CAACCAAGGT AAGGGACGGG GCGGAGGAGC
2151 GGGAGTGGGT GGGAGGAGGA GGGTGCTTGG AGAACCAGGG TACTGGTTGC
2201 CTCCTGCAGG TAACTTTGTA CAGGGGTCAG AGTCTCCTGG CTCGCCACAC
2251 GAGGGGATCG AGGATGTCCC CTTACCCTAG CGCCCTGTTT ACACCGCCCG
2301 GGACGGTGAC TCCACAGGCT AGGATCCGTT GTGTTTCTAA ATGTCTTTAA
2351 ACGGTAGCGT GAGCATCAGC TGCAGTTGGG TCCCACCGCT AGCGGCCGTG
2401 GGACCGCTCC CCGCTGCGCT GTCTCCACTG GAAGTCAGGC TCCGTGGCAC
2451 AGACTTAATG GAGACTTCTG GCTCTTTGGT GGTCGCTCTT CTCAGGGGAA
2501 CGTGTGGTTC TCCCACATGC CTTCTTGAAA GGCAGGGTGC TCCCGCTGTA
2551 CCCCGTGACC AGTTATCAGT CTTTCCCCAC CCCTCCGGTG ACTGCCGCCC
2601 TCGCCCAGCC TCAGTCCCCA TGCTTCATCT ACCATCCAGG CCACCGAAGT
2651 AGACTTACTC GAAATTCTTC CTAGACCAGA TGCTCCAGAT CTGTGTAGGG
2701 GTTTCATATT CTTGCGGGCA GGGAGTAGAA AAGGGTTTAG GGTGAATTTC
2751 CAAGTTGTGA ATACCCTATT CATGAAGTCA AGTCACTGAC AGATTGCTTG
2801 GAGGACTTTG TTTCGGTGGG TAAAGTGGTA AAGTGAAGGT AAATAGTGGT
2851 TAAAAAGTGA TGGAAAGCCC TTGGAATATT TGAGCATTTT CCCTTTTTCT
2901 ATTCATACAA TCTTCATGAA ATATATCTCC TTGTATTTCT GCTGTGCATA
2951 AAGATCTATA AAAAGTACCA CCTGCATATT CTAAGTCCTT TCAGACTAAG
3001 CATGAAACAA CCATAAAAGT TTCCCAGCAT GTATCTGGCT AGATATTCTC
3051 TCACTCGTGC TGTAATGACC AACCGATATG TCCCTTCAAA TATTATGTGT
3101 GGTAGTCAGT TATAGTTATC ATTTAACATA TAAGGCATAT GTTTCAGAGT
3151 CTCGAAGTAA TTTGCAGGTA TAAAAATGGA GGTCAGATGG CTTGAAAGTG
3201 TTCACTTTTT GTGTGAGGAG AAGGTTAAGG GAGAAGATAA ACAACACAGC
3251 ATTCTTCTTT GTCATCAACA TATATGGCCA TTTTACTTAG AAATGTTCAG
3301 AATCAGAATA AAATATAATT ATTAAATTGT TCTCATTTAT ACAGTGGTAC
3351 TTTGGCATAT TTTCCTAATT ATTACAGTTA TTTTAAACTG ACAGAATGCA

FIGURE 3A

3401 ATCACAAATG TGTAGGTGAA TTTGGAAACC ATACATAACC TTCATGGCTT
3451 TGAAGATAGA TCACATAATA GATATCAGTT ACAGTGTCCT GTTTTGCTGT
3501 GGTGGTATAT ACCATCACAC TACATCCCTC ATTTATTTTC AAAGACTGTG
3551 GGTATAAAAT ATTGAATAGG TAGTTAACTT CATTTCTGTG AAGGTAGAAG
3601 ATTGTTAAAA AACGTGTAAC GATTACCCTT TTTTATTATG ACAAAACAAT
3651 TTTTAATAAT TGGAAAGTCA GACATTGATA CTGTACTTTA TAATAGTAAG
3701 TAAGGATACT AGAGATGAAT ACTTTGAGAG TCAAGTGTAC TAGAAGTTTG
3751 TAACAGTTGT TCCCATGCAA TAATTTCCCC AAACAATGTT TATTTATTTA
3801 AATACCTATG ATGCATCAGT AACTACCCTA GGCCCAGGGG ATACTAACAT
3851 AAATAAAACA GATATCTGAA TCTACAAATG ACCCTAAAGT GCCATTCTGC
3901 CAAAATATGT CCTGTTAAAG CATGACCTTT CAGACATTCA TAGTAAATTT
3951 AAAAGCATCG AGATGTTATT TATTAACCTC TTCCAGTAAT TTTTATTTGC
4001 TTATCTATTT TAATGACTTT CTCATAGTAT TTACAGATGT TTGACCTAGA
4051 ATATATGCCA AACATATGTA ATTTATTTAT TTTTATTAAT TAGCTAAACT
4101 TAGTGAATGA GTATTATCCA ATTTTCCCAT CAGTTAAATA GAAGCATTAA
4151 AGATTGTCTA CTTAAACTCT TAATTTGAAT TTGTATTGAT ATACCGATAA
4201 CACAGGCTGT GCATAAGAGT ACAGTGGGCA AAATAGTACC TGAAGGTTAA
4251 ATTGGATAAA ATTTAGGTGA CTTCTTCAAA AGAACATTAT AATCAGAATT
4301 TTTATCAGAC ACAAATTATT ACTTATAAAA TGATGCTTTT TACAGCCTAA
4351 AGTCATAGTG AGTAGAAATT TTTCCTGATA ATAAGTTGAG ATAACTTTCA
4401 AATATTGAAA TCATCACACT AATGGTTAAT AAAATGCTAG GTTTCTAAAT
4451 GTTATTCTTA ATAACATTTT AGGGATATTT TCCTTACTCG TAGTTTCATA
4501 ATGGATAAAA TAAAGCATCT ATTTTTAAAC ATGGAAAATG GGACATTATA
4551 GAATTATCAT ATGTATTCAA CATGGAAAGA TAAATGTAAA ATATAAATTT
4601 GATTTATTAT ACACATAAAA ATAAACAGTA ATATAATTCA TATTTAGTAT
4651 TGAGAAGATA GTTTTAATTG TCCAATAATT TTCACTTTAA AGGCTAATGG
4701 AATTAATGTT TTAATTTTGA AATTTGTTAT TTTATAGAGG GTAAAATTAC
4751 ATTTATATGT AACTTCTTCC TGATTAAAGA TATTCACAAA ATAAAATTTT
4801 AATGTTATAT ATCTGTTTTA CCAAATTATA TGACATCCTT CATGGCTGAA
4851 AAGAATGGAT TCACCTTTCC CACAACCCCC ACCCCAATCC CCATTTTTCC
4901 ATACATAAGC AAGGTAAAAT GATGATGATA ATGACAAAAA AGTAAACTAC
4951 CTCATTCTTT TAACGTGGTG CAAACAGTAA CTTGACTATA GAAAGGATCT
5001 CTTCTCTTGT CTTTTAACTG AGTGTGAAGC TGACTGTAAA GATGAAATAA
5051 ATCAATTTGA CTCTCTCTTC CTATGAACCA AACCTCCTTG AATCGATCAG
5101 AAAGTAAAGG TTCTTCCTAG ATCACTTCAT CTGATTAAGT AAGTGGAAAC
5151 ATGAATTGTG TTTAAATCTC TCTCATAGTC AATTAATTTT CCCTGTATTT
5201 AAAACCACAG TATTAATTAA GTGTTGGAAA TTTTTATTTT AAAAACATTT
5251 CATCTTTTCA AGGAATATAG CCTTTCATTT CTGTACTATA CACTTATATG
5301 AATATAAAAC ACAATCTTGC TTCATGTATA AGTTAACCAT TTACCGTGTA
5351 TCACAGTGGC CAGTAGACAC CAGGGATCCA TTCATTCAAA GATTATTCTG
5401 CAGCAAATAC TACTTTATAG CCTAAATGAG TTGATGCATA TCTAAGGGTG
5451 TGGCTCATGC TTTTACAAAT AATCAATTGC ATACTCAAAT AATTCAATTA
5501 AGTCAAAGTA TGGTATGGGT AAGTTAGTCT AGTGAACTTA TTTTATTAGC
5551 AATACTTTGT GAATCGATTT TCCCCCCAGG CAATTCAGTG ACAAACAAAA
5601 TAAGCAAAAC AATAGTGTGG CTGGTTGATT TCATTAAATT TATTAATTTG
5651 AGCGAATCAA CTGCATAATC CACTGAGTTG TATATAAATA CAAATAAATA
5701 TATCTAAGCA GAAAAACATC TGCTTAACAA AATTCATGGC CTAAAATTAG
5751 TTTTATCCAT ATGTTTTATT CACAAACTCT GATTGAATAT TGTTCTTATA
5801 TTTATAGAAA TGGAGACATT GAGGAAATTT TTAAAGATTT TTCAAAAGTA
5851 AACATTAAAA TGCTGAAAAT ATTAAAAATT TTGTTAAATT AGGAACACTG
5901 GATTACTTAG AATGTTTCTG AAAGACCATT CATTTAGAAG AAATTAGTTT
5951 TTGAGGATAA ACTATTTATA GTTGTAAGGG TTCCAGAGAT TGTTATCACA
6001 TCACTTCTTG TTAGACATAA GTATAAATAC AACTTAGAAT ATAATTTTAT
6051 TATACATTTA CAATATAAAA TAAGTAATTG TATAATTAGT CATTATTGAT
6101 TAGCATCCAA AGTACAAAGA TAAAATGTTT TTATGCAGTT CCAGCAGTGA
6151 TCATCTAATT GTTGTTTGTT CTGGTCTTGG GATAATACTA TATCTAAAAG
6201 AAAATTTCTT GCACAAAAAT TATACATAAT CCTTAAGGAA CTCTTCTTCA
6251 AACAAAAAAT AACTTAAATG AATATAGTTG AAGTTAATTT AGTATTCATG
6301 ACTATAGCAC TTTTATATGA ATTTCCTAAG GGAAAAGTAT ATATCTATTG
6351 GTACAGGGGA AATTAATGAT TAAATTACAT CCTTTTACTT TTTTGTTACT
6401 TTTACATCAC AAAATAAGTA TTAAAAAATA TTAGAGTAGA AAGCCTTTTG
6451 CTTCTTTGTT TCTTCACTAA TCATTGTTAG TATAAATGAC TTAAGTACAA
6501 AAGATATAAA TTTCCCTCTA CCAACCCTTT TTCCCTATCA CAATTTCAGT
6551 AACTCTCTCT CTTTCTCTCT CCCACCTCAC ATACACAAAT GCTTCTGACT
6601 GCATGCTCCA TTTGTTCTAA ATGGTGAAAG AATAGATCCC ACTTCACACT
6651 GTTCATCAAC CAAATCCCAA CAGTAATAGA AATTTTTTCA TTGTACCCTT
6701 GACTCACCAT TTTGGGTTTA CAAACATGCT GGAAATCAAT ATATATAGTT
6751 AGGTGATCAA AATAGTTTGA CTTTGTCCAA CATACATTGT AATCAAACTA

FIGURE 3B

6801 ATTTAATACA GGATCAAATT GCGTATCTCT ACAGTGTTCT GTTCAACTTG
6851 TAATTTAATC AGACTGACAT TTAAACAAAC TGAAGATACA TTCTGTTCTT
6901 GCATTATTTT ATTGAGTATT GTGTTTTGTA AACTAAAATT TGGATTATGG
6951 ATTTAAAAAG AAAGATAAGG CATGTGAACT CATGATATTT GGGTAAGTAA
7001 ATAAAACAAT AAAGATTGTA AAAATTATAT ATGGATGAAG CAACAAAGAC
7051 ACTGAGAAAG TAACAGGAGA GATGTGCTAT TTGAAATGGG ACAGTTGGAA
7101 AGACTTGTCT TTGAAGGTGA CATTGAAACC TCATTCTCAG GGAAGAGAAA
7151 GAGCTCATTC TGCAGAGTGG GAAGAAGTGC GTAACATATA GTGGAAACTG
7201 ACTGAGCAAG GGTCTCGAAG AGAAATGAGC TTGACACATT TGAAAAACTG
7251 AGTCCAGGGT GGACTGGAAC TTACTTTGCA AGGAAGAGAG TTGCAGAAAG
7301 TGAAGTCTGA AAGATAGTCG GGAACCAGAG TCCTCAGAGT AGAATAAGAT
7351 TCATGTTAAG AAACTGAATT TTTATATTAT CCTAGATAAA GCATGAATCT
7401 ATAGGGAGGT TTTGACCAGT TGAGTAAAAT AAACCAATTT ACATTTTAGT
7451 AGCACCATGA CTAGTGAGCA AAAACTTAAT TGGGAGATGA CAAGAGTAGA
7501 ATTGGGAGTC AGTTGCAGTT GTCCGGGCAA GATGTATGGT GGCCTGGCAT
7551 AGAGTGATGT CGGTGGAGCT GGAGAGAAGA AGATGGGTTT GAAATATGTT
7601 TTGTAAATAG AATTTATGGG AACATCTTGT CTTTATAGAA AAATAAATGC
7651 AAGAAGCCCA GATTAATTTT TCATTATTCT TCATTGAAAT TACCTTACTA
7701 AATATTGATA ATTGCAAGGG ATAAGGAAGA TGGAGTAGAA CAAAAATATG
7751 TAGCAAGGCT GAGATGTGTA TTTTCCACTT GATTCAGTTC AAACAATAAT
7801 TTAAAATATA ATTTTAATAG AACAGTTTTG TTATTTCAAA CCATTGTACA
7851 TAAGGTAAAC TCATTTGGAT CAACAAATGC AATTTGATTC ATTTCTGACA
7901 TGGTAACTTT TTATATGTAG TTATTTTTTG TCAGCGAACG ACTGTACAAG
7951 TATGTAGGGA CATCTTCATA TGGCAACATA GTAAGCCAGC AGAGTCTAGG
8001 TTTTGGCTAA TAAGGAGCAA TATTTGAGGA TTTGACATAT GTACCAGTTT
8051 TATTCATCTC TATTATGATC AAATTACTGT TATTGAAAAC ACAAATTCTA
8101 AGTGATACTA GATATAAAAT AATGTGTTTT CAGATACTTT CAATTATACT
8151 TATCTGTTCT GTTTAAATGA AGAAATGTTC AGCAAGACCT AGAAAATGAG
8201 ATTTCAGGAT ATGTGATATT TTTGGGGATG GAGTGAGGGA AGAAACTGTT
8251 ATACTTTTAA GTAAACAACG GTAAATTTTA TGCAATTAAA AATTTTATAT
8301 GACCAGTCAA TTACTGATTA TTTTGAGTTA CCTTTTAATA CTACTACATG
8351 AAAATAATTA TTAAATGTAG AGAACATAAA AATTCTTAAC ACTCTTACAC
8401 ACTGTTTTTT AGAAAATTCA TATTCTGGAG ATACTTCATT TAAATGTTTC
8451 TAAATGTATT TAAACATATA TCCAAATGCA GTAAATCTTA CATTTTACTT
8501 TAGTGCTTTA GAATGTTCTG GAAAATACTA TTTTTATAGT TATTTCATTT
8551 AAATAAACTA TATAACTTCT TATGGGCTAT ACAGTTTCAG TTTTCAATTA
8601 TAAATTCTCT AAAACAAAAT GATTATTTAA GCAGATATTT ATTGCCTGCT
8651 ATATGACTAG GCAGTGTATT TGCCATACAT AAAGGTTCAA AGAGAACTTT
8701 TTTCTCCCAG AATATATGAT CCAGTAAAGA GTTTACAGTC TGTTTCCAGA
8751 TCTGATAGGA AAAATTTGTT TTCTCAAAAT CAAATTAATA ATCAAGTATA
8801 AAAGCTTTAA AAATGTATTT GTTATATGAC AGTGTATACC AATTAACCCC
8851 AATAAAGAAG ATTTATGTAA AGATTTATTT AAAAATATCT ATTATTTTAT
8901 TACATTTTAT TTTAAAGTTA AGATAATAAG TCACTCAGCA ACCATAGATT
8951 TAATATCAGG CATTATGCTA AGTATTGAGG TTACAAAAAG ATTATCTTCA
9001 TATTCTGTTC TCTTGAATCT CAGTTTGCTT ACTGGCATTT TATATTTTGA
9051 GTAATTGATA TTTATTTTTC AATTACTTGG TGGTTTCTAT AAGATGAAGA
9101 ATTTTACAGT AAATGATGTT GCATGGAAGA AAGGGAAGAG AGTAAAGAAT
9151 TGCTGTGTAC CATATGTGTT TTATTTGTAA ATTGCTTCAC AAGACTCTTC
9201 TGATGTTAGT TGTATGGATT GGCAGATATT CTACTTAATT ACATAAAAAT
9251 GTATAAATAT GCATTTTACA AACATGTTCA TATGTACAAA AAATAAATAT
9301 TTCACACATT TAATGACATC GTGGATGGAT GTGTGAGTTG AGCTTTTGTT
9351 CAAAATATGT TAGACTGGCC TATTCTGGTG TGCTTATTTT TGGTGGGTTA
9401 GTTATTAAAA ACTAATTCAT GTTGAAGATG CTAAGTTTCC AATTTCAAAT
9451 CGTAGCAATT GTATGTTTTA ACTGAGCTTT GTGAGAATTG GGATGAAAGT
9501 GTGTATTTTC ACTCCAGTTC CTGAAAAATA TATTGAGCTA GTTTCCCGGG
9551 ATTCTGAGTC CTCCAGCTTT TGGCCTATTT GGTGACCTGT GCTTGATAGA
9601 TGTAATTGAC AACTCATTAT GCTTCCTGCT ATTTTACTTC GTAACTTCAA
9651 ATGTAAAAGA CGTACTTTTT GATCAGAGGA AATATGAAAT AACATTGCCT
9701 TAGAAAATGG TTGTTAAGGA GATAGAAATA TTTAATTTAT TATTTTACTC
9751 TTGTAATGTT AGGTATCTAT GTGGATATCT GGATAAAAAG TAAGATACTT
9801 TATATATAAT TTAAAAGTAT ATTTTAAATA ATTTTATATA TAATTTATTA
9851 TGTTAATTCA CTAATAACAG TAAATTATGT GTTCTTTCAG GTGACTGTAC
9901 TATAATATAC TTGTATTTTG AGCTACATGA GTGTTGCAAA GAGAATCACA
9951 TTCTTAGGTA GTGTATAGAG TATAACACCT AGAAATAGGA AAAGCACTAA
10001 CTTTTAATGT TAAAAAAGAT CCATAACTTT TTAAAAAGTA TAGAAACTTG
10051 CCTACTTGTG GTAATTATAT TTAGATGTAT TTAAAGCAAG TTAATAAAGA
10101 TAAATGTTGT GTACTAGGAA ATAAAAAAGT TTCATTAATA TATATTCTAA
10151 GTAAGAATTA TCTAAGAAAA ATTGATATGA TTGCCCCCAA ATTTGAGTGG

FIGURE 3C

| | | | | | |
|---|---|---|---|---|---|
| 10201 | AATTAGTCTT | GGTAGCACCT | TAATTTTTAT | TTTTAAAGAG | AGGCATAGTG |
| 10251 | TTCCATATGT | TGATATAAAA | TGACACTAAT | ATTGCAAAAC | ATAATTGAAA |
| 10301 | TTAAATGAGT | AAATAGAGAA | TTTAAGTATG | TAGAGGCCAA | TAAATTAGTT |
| 10351 | ATTCTGAGAA | TTGATATCTC | ACACAAGTAA | AATTGATTTT | TAAATACAAT |
| 10401 | GCAGTAGCTA | AGTAGCTATA | AACATACCAA | TGATTAAAGA | AAAACAGAGT |
| 10451 | CAGGAGAAAA | GCTGATCCAT | GGCAGTATTG | TTTAAATGAT | TCTATTTGTT |
| 10501 | AAGGATTCTC | TCTGGCTGTA | TATATTCAAC | CATACTCTGG | CCTAGGTCCC |
| 10551 | TTGATTTATT | CCAGTATATA | AGTGTCCATT | GCTGACAAAC | AATCTTAGCT |
| 10601 | AAAACTTTTT | TTAATATTAA | AAATCTCTTC | TTTTCTTTCT | CTTGAGTTAA |
| 10651 | AGCATACTTA | AATAGTATTT | ATCTTGTGAA | GGCAAGTGAA | AATAATTAGT |
| 10701 | AGTTGCCATG | AAGTGTGATA | AGAAATAGTC | GAGCAGCAGA | TTCCATTGTA |
| 10751 | CAAAGTCATA | AAAGAATTGT | ATCAATTTTT | GAAATAAAAT | GAATCCTATG |
| 10801 | TATTGGTCCA | CTGCTAGCAN | NNNNNNNNNN | NNNNNNNNNN | NNNNNNNNNN |
| 10851 | NNNNNNNNNN | NNNNNNNNNN | NNNNNNNNNN | NNNNNNNNNN | NNNNNNNNNN |
| 10901 | NNNNNNNNNN | NNNNNNNNNN | NNNNNNNNNN | NNNNNNNNNN | NNNNNNNNNN |
| 10951 | NNNNNNNNNN | NNNNNNNNNN | NNNNNNNNNN | NNNNNNNNNN | NNNNNNNNNN |
| 11001 | NNNNNNNNNN | NNNNNNNNNN | NNNNNNNNNN | NNNNNNNNNN | NNNNNNNNNN |
| 11051 | NNNNNNNNNN | NNNNNNNNNN | NNNNNNNNNN | NNNNNNNNNN | NNNNNNNNNN |
| 11101 | NNNNNNNNNN | NNNNNNNNNN | NNNNNNNNNN | NNNNNNNNNN | NNNNNNNNNN |
| 11151 | NNNNNNNNNN | NNNNNNNNNN | NNNNNNNNNN | NNNNNNNNNN | NNNNNNNNNN |
| 11201 | NNNNNNNNNN | NNNNNNNNNN | NNNNNNNNNN | NNNNNNNNNN | NNNNNNNNNN |
| 11251 | NNNNNNNNNN | NNNNNNNNNN | NNNNNNNAAAT | TTAATAATTT | ATTTTAAGGT |
| 11301 | TAGTAATCTA | AAGTTTTAAT | AGGTTTATTA | AAGCTAAATG | GTATATATAT |
| 11351 | ATTTTAAATG | CTACCAAGCC | TTAAAATCAG | ATAAAATTTT | AAACATATTT |
| 11401 | CTATTGTAAA | TTTCTCAAAT | ATTTTGTCAT | TGCAATATAT | CTGTAGTTAT |
| 11451 | CTTTGGGTTT | TTAAAGTTTA | TTCATTTTAA | TTTTTTTCCT | TTTATATAAA |
| 11501 | CATTTAGGTT | CTTAATCTCA | TAGGTTTTAT | ATATAATATA | CATTTTTTCT |
| 11551 | GGAATTCTCA | AACTAGTTCT | GCAATAAGCA | AATATTCATC | CAATTTTTAA |
| 11601 | ATGAAATATT | TTGACACCTA | TTATGTTTGG | TGTGTTGAGA | AACAGGAAAC |
| 11651 | ACAAAGGCAG | GCCACTGCCC | CAACTTGTGA | GAGCTTACAG | TTTAGCTAAT |
| 11701 | GACATCAGTA | AATAATTAAA | ACAATTTTTA | AATATCAAAG | TTACATGTAT |
| 11751 | TCAGCTGTAC | AGTTGGTAAG | TTACCATCTA | CAAACTATTG | TTTACAGAAA |
| 11801 | TGAAAAGTAC | TGTTCTTAAG | GATATAGGAA | TTAATATACA | GAGACGTTGA |
| 11851 | GAATAAATAT | TCATTTAGTA | TATTGGTCAT | GACCATATGT | TAGCCACGAT |
| 11901 | TTGTGTGACT | CCTTAAAATG | AAATAAGATC | TGCCAGCTCC | CCCGCCCCTG |
| 11951 | CCCTCCCGCA | AAGGACAGTG | TTATAAAATT | GAAGAGGTAT | AGCTGAAATT |
| 12001 | AAAATACAAT | ATAAGATGGA | TAAAATGAAG | AGAAATGATA | TAAACTTTAC |
| 12051 | ATACAAATAA | GCCTGAGAAC | TTGAGAAGCT | TGAGTTATAC | ATGGGAAATG |
| 12101 | AAAATGAGTC | TCACATTTAT | CAGGATTTAT | CATCATGAAT | ATATGAAAAT |
| 12151 | AATTAGAGAA | TTAAGATGAA | TGACTACTCC | AGAGACCTCC | ATTTTAAAGT |
| 12201 | AACTGAATTA | GTTTTTATGC | GTTTAAAGAT | TAAAACTTAT | GCATTTAAGG |
| 12251 | ATAAAAAATT | AATATCCAAG | TGAATAATGT | TAGATTGAGC | ATAGAACTTT |
| 12301 | TAAATAAGTG | ATGTGACTTG | GCTTTTTTTT | TAAAGCTTTA | TCTTACNNNN |
| 12351 | NNNNNNNNNN | NNNNNNNNNN | NNNNNNNNNN | NNNNNNNNNN | NNNNNNNNNN |
| 12401 | NNNNNNNNNN | NNNNNNNNNN | NNNNNNNNNN | NNNNNNNNNN | NNNNNNNNNN |
| 12451 | NNNNNNAACA | TAAAATTGAC | AGTACATGTA | TGGTTTACGA | TATATCCAAT |
| 12501 | TTAAAATATT | TCTTCAAATA | CCTATAGTTA | CTTGTCATCC | CCTATCATGT |
| 12551 | TAAATATTTT | TATTGTTATT | TTCTCTTTCC | TAACTGTATT | AAATATTTGT |
| 12601 | TTTTAGTAGT | ATTGCAGAAC | TTTGGAATTG | CTGGTGTTCT | TTAATATTTA |
| 12651 | TCTTTAGAAA | TTAGGTAAAT | TGCTGTTTGA | TAGAGCCTTT | ATTTTTATAT |
| 12701 | TTGAGAAGCA | CATAGAATTA | GAAATTGCTG | CCAGAACTTG | GTGTTTTTAA |
| 12751 | ACAGAGAAAA | ATCAATAGCA | GATTACCCGT | GATTAGCTGT | TGACATTTAG |
| 12801 | ATTTGTACTT | TTAGAATGTC | AAAAGGCAGT | GAAAACTATC | AATCTAGTTT |
| 12851 | CTGTATTATA | ATTATACTCT | ATTTTTAAAT | TAAACATTTT | ATGGTCCTTC |
| 12901 | TTCCCATATA | TGTGATATAG | CCTTTTGGAA | AAAATTAATT | ATAATAATTA |
| 12951 | AAGATATTTT | GGTAAAAATG | ATGACCTTTA | ATAATTATTT | AGTCAAAAAT |
| 13001 | TAGAGGTCTA | CTGATAACGC | TAATAGATTA | TCCCTCACTT | TGAATACATC |
| 13051 | TAGGTTTTTT | TGTTATAATT | GCAACACCCT | ATTGCAGGCA | TCATTTTTAA |
| 13101 | ATTGTGAAAA | TAAATATTTT | TATAAGGTTA | GATTAATATA | TTTCTTCTAT |
| 13151 | AATCTTTATA | CAGTATCTAG | CATATAGTTA | TTTATTGCTG | TCATAAAAGT |
| 13201 | TATTTTAATT | CTATGCCAGA | TTATATATCA | TAAGTCTTTG | ATGTGTTTTC |
| 13251 | TCTGATAGTA | GATTATTTAC | TTAGGCTGTC | AGAATCTGAC | TTATAACCAG |
| 13301 | ACTTTACTGA | ATTGGACATA | TTTTCAAAGT | TTTGATACCT | TAATTCTAAA |
| 13351 | ACATTTTAGA | TAGACTGTAC | TACACACATA | AGACACTTGT | GATATAGATC |
| 13401 | CCATTTTTTC | AAATGCATCT | CTAGCTTGGG | TGGAAATTCC | ACTCTAGATA |
| 13451 | TGGCACTAGA | ATATTAAGAG | GCTTAAATGG | TACCTGTAAA | ACTAAGGGAA |
| 13501 | AACCACCAGT | TTCCTCTTTA | GTATATTAGT | AAATGATTTA | TTTACTCTCC |
| 13551 | AAGTCTAAGA | TTATCCTGTT | CAGTGCAGTT | TCTCTCAACT | TCTGGTTTAA |

FIGURE 3D

```
13601 AATATGAACT TGCTCTATTC CAGTGCTAAG GTAGGGGATA TTTTATGTGC
13651 ATTGGCTATT TTCCATGTCT TTCTATTAGC TGTTCTTAAA TTGGAAAGAT
13701 TGTGGTTTAT GCTTTTATGT CTAAGTTCTT TATATAGTCC TTATATATCT
13751 CACGTTATTT CCAAATATTT TTCCCAAGCT GTCTTTTAAT TGTGTTTATT
13801 ACAGTTTCAA AAACAAAATT TGCTTCAGCC CTCAAGTTTT TTCACTTTTC
13851 TTTTCCTTTT GAGATTTGCT TCTGAAGACT CATGCACACA TTGGTCGGTA
13901 GGCAATTGTG AAATAAAATA CCCATTTACC AACAGCTGAA TAAGTACTTC
13951 ATATACTAGT GATAAGCTCC TTGATAATAG GTCAGTTGTA CAATTATGAC
14001 TAATGGAACT TATTCCTAAG TGGGGTTCCT TATCTTCCAA TTTAAAACGG
14051 CCTAAATTCA GTCACCTAAT ATACATATGA AGAAGAGTGT TTGACACCTA
14101 CCTGGGTGTA GTTTGATGCC AGAGAGTGGG GAAGGTAAAG TCAGGCTTAG
14151 GAGGAGCATT TACATGGATG GAGGCTGACA CAAAAGAATG GGCATCTGGC
14201 TTTACTGCAT GTGTGCACTG ATCCTAAAGC CTCACACACG TTATAGTCTT
14251 CTCATTTGTC CAGCTCTGAG AAAGTTTTTC TTGAGTGGGA AAAGCTAGAA
14301 AGCAGTTGAA AGAAAGTTGA GAAGTTGAGT AAGAACTGGG ATGACTCTCC
14351 ATGTGAAAGC AAAGAAGTTT TCTTTTCCAG CCCTCATTCC TTAACATTGA
14401 ATATTTTTGG AGGAGTTTAT GATTTTTATG GAACAATGTG TATTATTCTT
14451 TTTTGTTAAT TTTTTGAGTT AAAAAAATGT GTAGAGAACA CTTGCCCATC
14501 CTATTTAACT TCATTTTCTA GATATGTTAT GGCTTCAGGT TAATATATCA
14551 TGCCTCAGAG GATGTTATGA TGGCAAGTAT TTCTTCTGAA GATATGAAGT
14601 GTGCTAGAAA GCAATTAAAC AGAATAGTGA AAACTGTTCA TATACTCGGA
14651 TCAATTAATT CCACTTTTAT GAATTTAAAT TCAAGACAAA TGACAAGGAA
14701 AAGGCAGGCC AATAATTATA TCCAAGGATT TTCATCTCAG CCTTATTTAT
14751 AAAATGGGAG AATTGGAATC AAATGTCCCG AAATAGGAAA ATATTTTTAC
14801 AGAGATAACT TTCTTTATTT GAAAAAAAGA TTCTTCAACA AGGGCATGTG
14851 CATCAACAGG GGTCCCAAAT TCCTTTGCAT GAATTAAATG GATAGACTTG
14901 TTTGGCTGCT AAGAGAGAAT ATAAGAGAAT TGACAGAAGA ATAAGGAAAG
14951 AAGGCTTGCA AGAACAGTCT AATGGAGATT CAGGGGTTGC TTTAGAGTGG
15001 CTAAGAAGAC AGTTAAAAAT TCGTGATTAT TGTTCTATTT CGGGTTGTCT
15051 TTGTGGCTAG GATGTTAACT CCCTCTTCAT CCCAACATCT TTACTTTGAA
15101 ACTTTCGCCA GTCTGTTATA CTCTGGAAAA ATAAGCATAT AGAAGAGAGA
15151 AATAAAAGTT CTCTGAGAAA AGAAAATCAG TTGCCCCCAT CCCTGCAAAA
15201 AGAAAAAAGA AAAAAAGATC TCCTAAACAT ATCAGAGTTT AGTTAATTGG
15251 GGTTCTACTA AACTTTTGCC CTATCCTTTT AGGCTGTTCA GAACAGCAGC
15301 TGGGTCAGGA ATTTTATTCC CATCTGATAC TAAAATGAGT TCCTAATTCC
15351 TTCAGAGGAG ATAACGTGGA CCTATCTAAC ATGACAGCAT TCCCACAGAA
15401 TTTACAAAGA GCAAAGGAAT GAAAGAAAAT TTAAAAAACT ACCTATGTGT
15451 CCACGATGTG TGCTCTTTCT CTTATCAGGA AACTCATGTC AAGAGTATGA
15501 GAGGTGGTGT TTAGAGATGG AAAAGAAATC TTAAAGTAAC CTTAAGGATA
15551 TGGAATCCAC TTTCATATGC TTTAGACACA CCAGCTCCAC CTTTGTTTTT
15601 ATGAGTGCTT AGGAATGGCT TGTCCACCTG TCCTTTGTTC CTGGAAATAA
15651 ACCCCGGAAT CAGATATTCG ACCATGGTTT CTGGCCAGAT TAAAATGGGG
15701 AAGTATTTTA GCAAAAGTGA AAGAGATAGG CTGTGTCTTT CTCCATCTCC
15751 ATTTTCCTGG ATGATCAACA CTGTTCCATT CCCAACACCT CCACAGCTCC
15801 ATCATTCTGA GCTTCCTAAT ACGTTTTGGT GGTTTTGCAC AGCCACCAGT
15851 CTAGACTGTC CTTGCTGCCT GATATCCAGC CAAGAGCTGA CTACACATCC
15901 TCTTGATTTT TAGCAACCAG ATAATTAATT TTATCACATG CTGTTACTGA
15951 CAAATGAATT TCCATTTTTG AATGGCAATA CTTGCAGATC TAGAGATAAT
16001 GTAAAAATAA TGACTTATAC AAAGTTGGGG TGCCTAGGGT CAGGAACAAG
16051 ATTTCTACAT ATGGACTAAG TTCCAGACTC ATATTTATTG ACTTTGTTTT
16101 GGAGGTTGGA AGCTGTCTCA GCCCAACTTT ATAATGGTTG TGAAAGGGCA
16151 CACTGAGGTA TGAAGAACAA GCACTTCATA CTTTATCTTA GACTGATAAA
16201 GATCATCTGT TTATCAAGAA CTTTTGCTTA AAATATATGA AAGTTCCTTT
16251 TTAAAAAGAA ATTTGATGGG AGTAGAGGAG AATCATTCGT TTTATGTTTG
16301 GAAACTTAAA AGGGAAAAAA ATTACCCCAC ATAGTCCAGA AGGTAAGGAG
16351 TACAGTTAAA TACATAATCA TCTCATTTTA CAGATGAGGA AACTGAAGCC
16401 TAGGGAGAAT AAATAATTAC TGTGGGGTCA CATAACCAGA AGCAGACCCA
16451 GGATTTGAAC TCCAGACAGT TTAGTTCCTG TCAAAAAATA TGTGCTCTCC
16501 CTCACTACAN NNNNNNNNNN NNNNNNNNNN NNNNNNNNNN NNNNNNNNNN
16551 NNNNNNNNNN NNNNNNNNNN NNNNNNNNNN NNNNNNNNNN NNNNNNNNNN
16601 NNNNNNNNNN NNNNNNNNNN NNNNNNNNNN NNNNNNNNNN NNNNNNNNNN
16651 NNNNNNNNNN NNNNNNNNNN NNNNNNNNNN ACTTGAAGAC TGAAATTCTG
16701 TATTAAATGC TGATGAGTAT CTTATTAATA CATAGGAAAT GGAAATATAT
16751 TGAGTTACTG AATTTTGCTT AAAATTTCAA AATAGCTTAC CTAGCTATTA
16801 CTGTAGTTCT TATAAACTTT CAGGCAGTTG TTTATATGCT GAGCTAATAC
16851 TGTCTGTATA CACATGCACG TGCATGTGCG CGCGCGCGCA CACACACACA
16901 CACACACACA CACACACACA CACAGAAATG GTATGCTATT TGCTCCATAA
16951 ACTTAAGTTC TTTTTCACTA GAGTGCAGTG GTTCACATAA TCCTAAGTAT
```

FIGURE 3E

```
17001 CGCATTTTAG TGCTATAATG AAAAGAACTA TAAATTTAAA GTATGTGTAC
17051 ATTTTTATTT TTTCTACTAT AATTCAGGTC ATATTACATT AAGTATTCTG
17101 AATATAACTT GCTTGAGACT GTAGTTATTA GGAATATCAA TTCTAATTTA
17151 GGTTCAAAAC AAATGGATAA CATCAGGTCT TTGTGCTTAC AGAGGATATT
17201 TCCCTGAAAA ACTCGAACAT GTTTTATATT CAGTAGTCTT TCTCACTAAT
17251 GCGCATATAA AAATGTATCT CCAGTTGATG GAGGATTTGA CATACCAGAA
17301 AAAAAGAAAA TACCAAATAC TTTTCAACTG TGTATATTAA TTCTACCACT
17351 TTTTCATTTT TATTCCACCT CTCTAAGGTA AGTAAGTAGC ATAAATTACT
17401 GTACTTATTT TACTAATGGA ATTTATATGG ACGTTAAGTT ACTTGGCAAA
17451 GCTGATAGGG CAAATTGGTA ACCACAAAGG AAAAAGAAAG CAGATTTTAA
17501 GCCTGTTTGA TCCATGTACT TTCTATTAAC AAATGGGAAA GAGAATTTCA
17551 GGAAAACTTC TAGAATATTA AAATGTAAAT ATATTACATT TAAATATTAT
17601 TTATCTTTAA GTCTTGAAAA TATGTAAGCA CATTGAATCT ATATCTTTTA
17651 TAAATAATCT GTTTTAAAAA TAATAGAAAG ATTATTTGGA GAACAATTCT
17701 TAGGGGTAAG GGGAAATGGG GGGGACATTG ATCACAGGGT ATATAGTTAC
17751 AGTTAGACAA GTAAAGAAAG TTCAAGAGAT CTGCTGTACA GCATGGTGAG
17801 CATAGTTAAT GATAATAAAG TAGATGTTAA GTGTTCTCAC TGCACAAGTG
17851 ATAACTATGG AAGGTAATGC ATTTGTTAAT TAGCTACATT TAACCATTCC
17901 ATTTTATATG TATATATATA CACACACACA CATATATGCT TCAAAAAATA
17951 ATGTTGTACA TGATAAATAC AATTTTATTT GCTGATTTAA GAAAAATAAT
18001 TGCTTTCCCT GTATTTTATA TTCCTTCGAT ATTTTTAAAA TCAGAAGCTA
18051 ATAGTTATGA TTTTAAGTAA TATTGTCATT TTTACTCTCA TTTTATTTAT
18101 GTATATTATT TTTGTGGGTA TAAAACCATT TACTATGTGA TTTTGCTTCT
18151 TCATTTATCA CCTGTTTATT AATTTGTCCT GTATGTTTAA ACTGTGTGCT
18201 AAACACCATA TAAGCTGTCT TGATTAATGA GCAGTAATGA AAACTTAAGT
18251 ACCTACTGAG AAGCCACACA GTTTGAGTCA TCAGCCCCTG ATCCTCCTCC
18301 ACGTGGGCTA CTTTTGATTT TCTTCCAATT CGCATCTATT ACAGCACCTG
18351 TCAAGTCTTA GTGTCTGTAA GAATTGTTGC AGAACTTGTT CTGCTGAGCC
18401 CACTCCAATG AGTTGGATTT AGTGTCTATG AGACAGTGTT TGTGATTGTT
18451 CATTTTTTTT TTTGCCAATT GACACTTTTA TTAAGAATAA AGATGATCCA
18501 TTCCTGTATT TTATTATTAT TATTATAGTT TAAGTTCTAG GATACATGTG
18551 CACAATATGC AGGCTTGTCA CATAGGTATA TTCATTTTTA ATAGGCATTC
18601 TTATATGATT TATTTGCAGG TGGTTTGAGA AACCCTGACT TGGACATCCT
18651 TATCTGTATC ATTCAAGTTC TTTGCAAGCA ATAGGAATTG AAGCTAGCTA
18701 ACATAAACAG AAAATAAATT ACTTATAAGA TATTAGATAG TCCACAGAAT
18751 TGAAGAATAT CTTAGAAAAC AACTTTAGAA AATGATTGCC ATCAACCAGT
18801 GCAACACCTG GAATGTAGGC ATCCGGAATT ATTCATCAGT CCCCTTGGGT
18851 TTAATTGATT TCAACTCTGC TTCTTCTCCT TGTATAACTC AGCTGAAAAC
18901 TCTCAATGCT GCAAGAGGAA ATCTGATTGG CCTTGAGTGG GTCAAGCCCC
18951 TGCATCATAG AAAGGGTAGA GTCTTTTTAT TGACAACCTT ACCATGACTC
19001 GACGCTATGT GGGAAAAGTA ATTCCTTAAA AATGCTGTCA CTAAAACAAG
19051 TGGAATGGGT AATGGATGGC CAAAACTCAG CGTATATCTA ATCACTTCAC
19101 TGCTCATGTA ATTATCGAAA TAACTTCTTT CAGATTTTAG CCCTTATTTT
19151 AAAAACTCGA TTTAGAAGTG AATATGACTT TATCTAACTA AGAGTCTATA
19201 GAGTTTAACA GTTCAGCCTA GGATGGTTAG GTGTAATTTT ACTACTACCA
19251 TCGATAGAAT ATTAACAATA TAGAATGCAT ATTATAATAA AATCATGAAG
19301 CTAAAGTCCC AATAGAATAG CATATATTTT CTTTTCCCCA AGTGTAATTT
19351 GTAACATCCT TTGTCCTGAT AAAACTCTTA TTCTGCAGTA TAGACAGTAA
19401 GGAAATATGT AGGTGGCCTG AACTTCTAAC CTTTCTTGTA AAAGAAATTT
19451 GACTTTTAGC AAATGGCTTA TGCTAAATCC ACAATTTCAG TACATTCAAA
19501 ATACTGTATA ATATTTTGGT TATTGCCATT GGCCTGGTTA AAAGAGAAAA
19551 CTTGTGCCAC ACAATATTGT GCCCAATATT GGTTTGGCTT CCATACACAA
19601 TTATTATGCT TTTAAAAATA AATTGATTCT TAAACTCTGT AACAAAATCA
19651 ATATACTTCT AAGTCTAATA TTTTTTAAAT AACCAGTAAC TGACATTTTA
19701 AGCAACTTGG ATTTTAAGAC TGCCAATGTT TCATCTAAGA AAAATTTAAG
19751 GAGAAAATTA CTTTTCCATG GGCTACCTTC CCACATGCAG TAGTATAAAC
19801 TATGAGTTTT TGAGTGCTTA CTCTTTGTTG GATACTATAC CAAGTAGTTT
19851 AGTATATTTA TGTAATCCTC ACAACCCTTT AAAGTTATAT TATCATTATT
19901 ATATTCATTT TAGAGGTGTG AAAATTGGAA CACAGAATAA GTAACTTGGC
19951 CCAGTGTTAA AGATTATTAG TTACAGTATC TTCTGCGTTG AATTATGTCC
20001 TCTCAAAATT CGTATGTTGA AGCCTTAACT CCTAGTGCCT CAGAATGTGA
20051 CCTTCTTTGT AAATAGTGTT ATTGCAGATG TACATGGTTA AGATGAGGTC
20101 TTACTGTTTT AGGGTGGACC CCTAATCTAG TATGACTGGT GTCTTTATAA
20151 AAGGGGAAAT TTGTTCACAG ACATGTACAC AAGTGGAATG ACCTGTGAAG
20201 ATGAAGACAG GTATTGGTGT TATGCATTTA CAAGCTAAGG AATACACAAA
20251 TTGCCAGAAA GCCACACAAA AAACTAGGAA GGAGGCATGG AATGGATTCT
20301 CCCTCATAGC CTTCAGAAGA AACTAACTCT GTGAAACCTC AGCCTCAGAC
20351 TTCTCACCTT TAGAACTGTA AGACAATAAA TGTCTGTGTT CTGTGTCACC
```

FIGURE 3F

20401 CAGTTTGTGG TACTTTGCCA TAGCAGCTCT AGCAAACTAG TTTACAGAGT
20451 AAGGATTTAT AGCTAGGCAT TGTGGCTCCA AAGCTTGCAT TCTTAAGGAG
20501 TAAACTATGG TGTCTGTGTA ATGGTAAGAG ATGGAGTGGA TATATCATCT
20551 CTTAGAATAT AAAAGAGATC TAGCTGAAGA AAGTTAAACC AGAGTAAGAG
20601 AGCTAATAAC ATTTTCCTGA AGCTTGAAGT GCCTCATTGT AAGAGTGTTG
20651 TGTGAGAAAG GAGCCTAAGG TACTGCTTTC CTTCAAAACT AACTGCATTT
20701 ATCATTTTGT TGCATTAAGA ACATTGCAAT TCCACTGTTA GTTATTTTAA
20751 AATATGCAAT AAGTTATTGT TAACTGTAGT CATCCTATTG TGCTACAAAT
20801 TACTAGACCT TATTCATTCC AATTCATAAA TATATACAAG TATTATGTAC
20851 CCCTAATAAA ATTAAAAATT AAAAAAATTT CCCAAAGCTA ACTGACAACA
20901 ACAAAAGAAA CAGTAATAAC TATGACTAAA TATGCTTGGA AAAATAATCT
20951 AAGATTTTAA CTATCAATTA TACATTTGTA TAAATTAATC TGAGTTGATT
21001 TAAATGTCAA AAAAAGCATC TCCCTTGATA AATTTCTGGA GGAAGACTAA
21051 AAGAAAACCA TAAGGAAGAT CTTGGTAGCT CCTTTGTGGA TGATGACCAT
21101 TTACATATAC CTCAGTTTAC AGAGTATGTA ACGTTTGCAT AAACCCAGAC
21151 TTTGAGTACC AGTGCATTAC ACAGGAAAAA ATGAAAGAAA AATGTGATTC
21201 TCAATGCATA GTGACCATAA TGGGGAATCT GCATGGTCTG CCCATGCCTT
21251 TTCTCATTAA AATAGGTAGC TGGAGAATTA AGGAAAAGTC ATGTGTAACC
21301 TAGGTTTTCC TGTTAAAAAA GAAGAATGGA ATAAAAGGCA AAAAGTGAAA
21351 GAAGAATTAG AAGTAAGTAG GAAGTATTTT GAAGGTGTAT TGATACCACA
21401 GCTCTGAAAT ATTAGCAGTA ATGAAAAGCT CAAGACGTCG GAGTTGCTCT
21451 GAATTGCTAA GGGTGGATAG ATAAAAGCCT GGAAGCCCTG TTGTTGTTTT
21501 TTTTCCTTCC AACTCTAAGA AGTGATTAAA AATGAGTTAA GGGGAGTTTT
21551 CTGGGATTCA ATAGAGGAGA TGGTGATTTT TAAAGCAGAG ATAGCTTACT
21601 GTTAAAGTTT GGTCAGTAAG GTACTTGATT TGTGTCTCCT TATATTTTTC
21651 TTTAATTTTT TACTCATTCA AAGCTGCATA ATCAAATAGG TCTGGAACTG
21701 AATATCAGTT CCATCCCTTA TTAACAATGA ATTTATTGGA AAATGGCGTA
21751 ATATCTAGGC TTTCCTTTAA TTATCTATCG AATAGCAAAA AAGACACTAT
21801 TTTTGTTTTG AAGATTTATA GATGGGGTTT ATGAGCAGGT GTCCGGCCAT
21851 ACAACAATTA TAATAATAAT GGTGTAATAC CCAACCTTAA TCAAATTATT
21901 ACCATGTTTT AAGCAATTTA GTCTTTATTT CATTCAGTCA TCACATCTGA
21951 ACTAAGAAAT AGTTCATGTT AATTCAACAA CACTTCAAAA ACTGACATAA
22001 TGAGTTTGAG TAATTTGCTC AAGGTCAAAA GATAGTAAGT TGTAGATTTG
22051 GAAATCAAAC CTAGTTCCCT ACCTTTGGAA TTCACGAACA CAATCAGCAT
22101 TTATTAAATA TATAACTATT GGCCCTGCAT TGGAGATACA AATATGAGTA
22151 AATTTAGTCT TAGTCGTCTG TGAATTTACT GTTTAATACA AAGAGACAGT
22201 TGAATGTGTA GAGAAAAGTG TTATAGATGT GGTGATGAAA GTATGTACAG
22251 CTTATCAAAG GCTTCAAAGG AAGTGGTGGT CACATCTACT TTCAAGTTTC
22301 AAGAAAGACT TTGTATAGGA CGTGAAGCTT GAGATACAGG TTGAAACATG
22351 AGTGGGTGCT CATCAGATAA TTAGTAGTAC AAATCATTCC AGGCAGAGGG
22401 AGTATCAAGT GCAAGGGGAT GGAAAATTCA TATGGGGCAG GGTGAGAGGT
22451 GACTGGCAAA TAGTTGGGAA TAGATAAAGA CTGTGAGGGG TAATGAGGCA
22501 AATAATGAAG GAAAATACAC ATGCATCGTT GAGGATAAGA AGAGCCTTGA
22551 ATGCTATGCT AAGTGGTTTT TGCTTTATCA AGAAGCCAAA AGTTCTTGAC
22601 CCCGGCTGCA TATCAAAATC ATTATAGGGA TTTTTGAAAA AACACCCATA
22651 TTTGAGTCCC ACCCAGATTT ATCTCTGTAA ACAAGACTTG CAATGAATTT
22701 TGGATACCTT TCTTCTTACT CTTGTGAAGA CTCTTAATTA TTAAGTATGT
22751 AGTAGACCCA CATAAGTATT GTTTATTTCC TTAACAAATG TGGTGGAATG
22801 AATCTCGTCA TTTCTGAATG GAGATGCATA GTAAACTTTG GCAAGAAAAA
22851 TTATGCAAAA ATATTGCCAA GAATGTCACA GTATTAAGGG GAAATAAGCA
22901 TCAATGATGA TTATTTTTCA CATTACTTGT ATAAAATTCA TCTTAGGTTC
22951 TATTTGGTTT ATGTAGGAAG AAACTCTGAA ATATAATCTA GAGATAATAC
23001 TTGGCTACTA CATGAGGTAT GCAGCACTTG ACAAGTAGCT TTCATCTCTG
23051 TGAATTTTTT CATAAACAGT ATTCTCTTTT CTCCTTCCTT CAAATCACAA
23101 AATCACTTTT CTTGGCATCA TACTAGTGCA TGAATAACTA TCTGGCAAAA
23151 TTATTTAGTC CATTAATATT TAACCTGAAG TTTGCTAATT TATTGCTACC
23201 ATGGGGAAAC ATATGAAGAA GCTTAAAAAA TAATAACCTT TTTCCTAGGT
23251 TGGCACCAGA CAGATTAACT AGGTTGGCTA ACACTGGTCT TTTTGTGGCC
23301 TTGGGCAGAT ATTTTAATCT CTTTCAGTCA CAGTTTCCTC CTTGGTAAAG
23351 TGCTGATAAT CCTTGAAGGT TCTATTTTAC AAGGTTGTTG TAGCAATGGA
23401 ATACTGTTTG TCAAAACGTT TTGAAAATTG TGAAGTGTTC AACAATTGTA
23451 TTCTTTCACA TACTGTTTTA CAGCAATGCT GACATCTGTA AACATTGCCA
23501 ATCAAGTCAT TTAATCATTC ATTCCACATT TACTGAACAA ACATTAATTG
23551 AATTCCAAAA ACTGTGATTC ATGTTGGCAT TAAACAGATG AGCCGTTCTA
23601 CCTCCCTTTT GAGTCAAAAA GAAGAGAACA GTAAAAGGAA GGGCAGATAA
23651 GCCAGTTGTA TCCAAGTGTC ACCATTATTG TGCCTGTGCA CACTTCAGTC
23701 CTGCAGCAGC ATCTGACAGT GCACCTTATT CTGTGCTGCC AACACACATA
23751 GTCTTGTCTT GGGTTATTAG ATTGAAATAG GGCAAAAAGG GGAAAGTAAG

FIGURE 3G

23801 TCTACCATTC TGCATAGATA AACACACTTA ATCCTCCTTT CACCCCCTAT
23851 GAGGTAGATA CCATTATTAT TCCCCTTTTT ATAAATCAGC AAAGTGAGAC
23901 ACCCAGAGAT TAAGTAACTT ACCCGAAAAC ACTCAGATAG GATGAGAACT
23951 TAAAAAGAAA ATGGCACTAT GTGAGGGCAT CTAGACTGAG TGATAAGATA
24001 GGGAGGCCAA GAGGAATTCC TTGATACAAA GGTCAGGAGG TGGAGGTGAC
24051 TTTTCATATT GGCTATTGTA GAGCAAATAG AAGTGTGCCC TGCATTCTCA
24101 AGTTATATCC TAGAAACAGA TGGACATAGC TTCTGTAACT GAAAAGCTTA
24151 GATGTCACGA GCACAGAGTA CAGAAATACA TAAACTAGTT ATCATAATTC
24201 TGTGTGGTAA TTGCTCTCTG GTAGTAATGT GCACAGGATT TCCTGGGAGA
24251 TGAGGAAGTG TGGTGTGACT TACTCTGCAT AGAGGGGTCA GCAAGGCTTC
24301 TCACAGGACA TAATGTTTGT TCAGAGTATT GAACAACATT GTTTATGATG
24351 AGGGAGAATC AGCAGTAAAG GGCATTTTTA AAACATGGGA GAGATCATTC
24401 AAAGACAAGG AACGAATTTT GTATGTCTAT GAAAGTGCAA CTAATTTGGT
24451 ACAGGTGTCA TTTAGAGGGC CAGGACAGAT TGGAGACAGG GGAGCAATTG
24501 AAAAATGAGG CAGTCCTAAA CTGTTTACCA GGTCAACATG TTTCAATAAT
24551 ATCTTACTTT TGGACCATTT TCAGTACGAT GTCTTTAATA CCTTTAAATA
24601 ATAGCTCATT TAATCATTTT TGGTGTATTA TGACAACTTT AGGCAGAGAC
24651 ATTTTGATTA TATTATTAAT ACGTATAACA AAATCAAAAT TAAAACAAAA
24701 TATAAGGCAG TATTTCATCT TTTTATTTGA GAATTAATGC ATACTTTAAA
24751 GAATAATCTT TCAAGTTTTT TTTAACTTAA TGTATCTTGG AGTTTTTTAT
24801 TTAAATTTCC AAATTTTACT TTAAGTTCAA GGGTAAATAT GCAGGATGTG
24851 CAGGTTTGTT ACACAGGTAA ACATGTACCA TGGTGTTTTG CTTCACAGAT
24901 CATCCCATCA CCCAGGTGTT AAGCCCAGCA TCCATTAGCT ATTCTTCCTA
24951 GTCCTTTACC TCCTTCCACC TATGGCCCTC CGACAGGCCC CAGTGTGTGT
25001 TGTTCTGCGC CCCCCTGCCC CCCACCCAAT GTGTCCATAT GTTTACATCA
25051 TTCAGCTCCC ACTTATAAGT GAGAGCATGC AGTGTTGGAC TTTCTTTTCC
25101 TGTGTTTGTT TGCTGAGGAT AATGGTTTCC TCCTCCATCC ATGTCCATGC
25151 AAAGTACATT ATCTCCTTCC TTTTTATGGT TGCATAGTAT TCCATGGTGT
25201 ATATGTGCAA CATTTTCTTT ATCCAGTCTA TCATTGATGG ACATTTAGGT
25251 TGATTCCCTG TCTTTGCCAT TGTGAATAGT GCTTCAGTGA ACGTACACAG
25301 GCATGTGTCT TTATAATAGA ATGATTTATA TTCCTTTGGG CATTTACCCA
25351 GTAATGGGAT TGCTGGGTTG AATAGTATTT CTGCCTCTAG GTGTTTGAGG
25401 AATCACCACA TTGTCTTCCA GAATGGTTGA ACTAATTTAC TTTCCCACCA
25451 ACAGTGTAAA AGTGTTTCTT TTTCTCTATA ACATCAGCAG CATCTGTGTT
25501 TTTTGACTTT TTAGTGGTAC CCAGAATAAT TATAATTTTC TATAATTCAA
25551 ATGTATATTT TAATATATCA ATTAAAAGGT CTCTGCTTAA TATGACATAA
25601 AAACTTCTTA GTATTTCAAT ATTTGAAATT TAACAAATTT GCACTAAAAT
25651 TCTTAGTGGT TCATTTATAC AGTGATCATA CCCTAGTTCT AAATAACAAC
25701 ATAAAGAAGA GGTCACACTG CAGTTTCAAG TACTTATATG TGAATGGTAC
25751 ATTTTGTGTT GAAAGCCCCT CCCCCAATAA ATATAATGTT TACTATATTT
25801 TATATTTTTA TTGTAGCTCT ACATCAGTAT TTTTCATGCT TTTCACTTTA
25851 ACTAGTGGTC ATTTCTTGGT AGATATTTAA TACTATGTGA CTTAGAATGA
25901 ACAGTTTTAC CTAGCAAGTG GTTCCCAGCT GAGAAAGAGG CTACACTGAC
25951 ATTAGTCTGT ATCTTTATGG CTTCCATTTT AAAGCAAAAC TATTTGAGTT
26001 TTTATGTAGT GATTTAAAAA CTATAAATTG GAAATCCAAA GGTAAAAGTT
26051 TTTTTATTTG TACATTTAAA CTTAGTATCC CCTACAGCAG AGGTCCCCAG
26101 CCCTGGGCTG CAGACTGGTA CTAGTTCATG GCTTTCTAGG AACCGGGCTG
26151 CATAGCAGGA GGTGAGCATT GGGCAAGCAA GCATTACCGC CTAGTGTCAC
26201 CTCCCGTTAG ATCAGTGGTG GCACTAGATT CTCATAGGAG CGTGAACCCT
26251 ATTGTGAACT ACACATGTGA GGGATCTAGG TTGTGTGCTC CGTATGAGAA
26301 TCCAACTAAT GCCTGATGAT CTGAGGTGGA ACAGTTTCAT CCTGGAACCA
26351 TTCCCCTGCT TCCAGCCCCA CATCTGTCAT CCATGGGAAA ATTGTCTTCC
26401 ATGAAACTGG TCCCTGGTGC CAAAAAGTTT GAGGACCGCT GCCCTAAAGA
26451 CCTAAGGGTT TTGGAAGACT TTAGTTGGGA ACTATTATTG TAGTTGATTA
26501 CAACCCATTA ATAGGTATTA AGAAATGAGA AATAATATTA ATATTAATAA
26551 GAATTAATAT TTTAGAATGC TTACCCTGGA AATGAGGAAT GCTATGGAGA
26601 CTAGAGTCAG AGGTGTTAGT TAAAAAATAG TTATGATAGA CTAGGAATGT
26651 GAAAAAAAGA TTTCTGAGAA ACCTTATAAG CTTTCTTAAA ATTTGGTAGT
26701 TTGGTCCTTA TTGTTGGGCA GGTTGTTGAT GTTGTAGATA CTTACTAGGC
26751 ATTTGTTAGC ACAGCAGTAA ATCTATTATA TTATTAGTAT GTTTTAGGGG
26801 AAGGATGATT AAGTAATCCA GTTAAAAAAA TAATAATTCT GGCCCCAGGA
26851 TGAATGGTGG TTAGAGAGGG CAGGAATTGG TAATGGGAGA CCATTTAGAA
26901 CACTATTGTT ATTGTTCAGG GAAGAAATTA TTGCAATTTA GACTAGAGTA
26951 GTGCCAAAGA GTATTGAAAG AGTTGATGGA TTTCAGAGGA ACATGTGCTG
27001 GCTGATAAGT GCTCCAGTTC ACAGGTAATG AGTGACACTT AGCTCACAAC
27051 TCACTGGCTA CAGCTAATAA TATGTCTGGT CCCAATCATC AGGGCCCAAG
27101 AAGTGCAGTT GTACCATGTA CCTGAAAGTT GGAGATTTTG TGAACAATAA
27151 TAGTGATTTT CTCAGTTTGC TCTTCTGGTA ACCAGATACC CAACTAATTC

FIGURE 3H

27201 TGCCTTTTGT TGGCAAAATA TATACACCTC TTGGGGGTGG ATTTGGGATA
27251 TCTGTTATTT ATCTGTAATC TTGATTTACT CAGAATTATT TATTTTTCTC
27301 TTGACTCTTG ATTTCTATGA AGTCAAGAGA GATTTCACAC AGGTGCCGTT
27351 GTTTTCATCT TTATTGGCTC AGCAAGTCTG TCAGTAGTCC AAACCACTCT
27401 CACAGGAAGT TTAAAATGCC TTCGTTATTC TGGACCTTGG GCCTGTAGTC
27451 GTGAGCAAGA GTGATAGCAG CAGTTTTAGA GATCTGAGCA AAAGATGAGG
27501 AGATGAATGA CTTGCTGTCT GACCACTACC TATGTATAGG ATGTCAGTGT
27551 GATTTCTCTG CCTAACTCAG AGCTGACACA CTGGGTGAAG GTACAATTCT
27601 GGAGTGGGCA AGAACACTGC CAATTCAAAC CAAAGAAAGT ACTGAGTCCT
27651 GATTACCGGC CGGTGTCTTG AGGTGGGACA GAAATCTGAA TTTAGTAAAG
27701 TTGAGTCATT ACAGTGACTG CTTAGAGAAA AAAGATGGAG ATGTACTTCC
27751 CTTTGGCCTT ACTGTGGCAA TGGAGTTGAC AAAACTGAAT TTAAAAAAAT
27801 CTATTCATTT TTGTTTTAAA GTTTCAAGGG AACCTACCAG AGCTTTAAAA
27851 GTAAAAACAA AAATTATGGT AGTAATTAAT ATTGTTTTGT GAACCCCCAA
27901 AATCTGAGAC AGGTCTCAGT TAATTTTGCC AAGGTTGAGG ACATGTGCCC
27951 GTGATAGTCT CAGGAGGTCC CGATGATGTG TGCCCAAGGT GGTAGGCGAA
28001 CGTTTGGTTT TATACATTCC AAGGAGATGT GAGACATCAA TCAATATGTG
28051 TAAGATGTAC ATTGGCTCAG TCCAGAAAGG TGGAACAACT CGAGGTGAAG
28101 GCTGGTCAAC TTGAAGTGGA GAGGGGACTT CCAGGTAATA GGTAGAAAGA
28151 GACAAATGGT TGTACTCTTT TAAGTTTCTG ATTAACCTTT CCAAATGAGG
28201 CAATCAGATA TGCATTTATC TCAGTGCATT AGAGGGGTGA CTTTGAACAG
28251 AATGCGGGCG GGTTTGCCCT AAGCAGTTTC CCGCTTGACT TCTCCCTTTA
28301 ACTTAGTGGT ATTGGGGCCC CATGATTAAT TTTCCTTTCA CAGTTTGTAT
28351 AAGCTTTCCA TCTTTCGATT TCCAAACACG TGTTAGGATC AAATTTTCTA
28401 GCCGGCTTTG TGGTTGGGAA AGGCCATGTG ACTAGTTTGT CCAATGAATG
28451 TAGATCAGAA GAAATGGGTG TGTTACATTA AGTGCCANNN NNNNNNNNNN
28501 NNNNNNNNNN NNNNNNNNNN NNNNNNNNNN NNNNNNNNNN NNNNNNNNNN
28551 NNNNNNNNNN NNNNNNNNNN NNNNNNNNNN NNNNNNNNNN NNNNNNNNNN
28601 NNNNNNNNNN NNNNNNNNNN NNNNNNNNNN NNNNNNNNNN NNNNNNNNNN
28651 NNNNNNNNNN NNNNNNNNNN NNNNNNNNNN NNNNNNNNNN NNNNNNNNNN
28701 NNNNNNNNNN NNNNNNNNNN NNNNNNNNNN NNNNNNNNNN NNNNNNNNNN
28751 NNNNNNNNNN NNNNNNNNNN NNNNNNNNNN NNNNNNNNNN NNNNNNNNNN
28801 NNNNNNNNNN NNNNNNNNNN NNNNNNNNNN NNNNNNNNNN NNNNNNNNNN
28851 NNNNNNNNNN NNNNNNNNNN NNNNNNNNNN NNNNNNNNNN NNNNNNNNNN
28901 NNNNNNNNNN NNNNNNNNNN NNNNNNNNNN NNNNNNNNNN NNNNNNNNNN
28951 NNNNNNNNNN NNNNNNNNNN NNNNNNNNNN NNNNNNNNNN NNNNNNNNNN
29001 NNNNNNNNNN NNNNNNNNNN NNNNNNNNNN NNNNNNNNNN NNNNNNNNNN
29051 NNNNNNNNNN NNNNNNNNNN NNNNNNNNNN NNNNNNNNNN NNNNNNNNNN
29101 NNNNNNNNNN NNNNNNNNNN NNNNNNNNNN NNNNNNNNNN NNNNNNNNNN
29151 NNNNNNNNNN NNNNNNNNNN NNNNNNNNNN NNNNNNNNNN NNNNNNNNNN
29201 NNNNNNNNNN NNNNNNNNNN NNNNNNNNNN NNNNNNNNNN NNNNNNNNNN
29251 NNNNNNNNNN NNNNNNNNNN NNNNNNNNNN NNNNNNNNNN NNNNNNNNNN
29301 NNNNNNNNNN NNNNNNNNNN NNNNNNNNNN NNNNNNNNNN NNNNNNNNNN
29351 NNNNNNNNNN NNNNNNNNNN NNNNNNNNNN NNNNNNNNNN NNNNNNNNNN
29401 NNNNNNNNNN NNNNNNNNNN NNNNNNNNNN NNNNNNNNNN NNNNNNNNNN
29451 NNNNNNNNNN NNNNNNNNNN NNNNNNNNNN NNNNNNNNNN NNNNNNNNNN
29501 NNNNNNNNNN NNNNNNNNNN NNNNNNNNNN NNNNNNNNNN NNNNNNNNNN
29551 NNNNNNNNNN NNNNNNNNNN NNNNNNNNNN NNNNNNNNNN NNNNNNNNNN
29601 NNNNNNNNNN NNNNNNNNNN NNNNNNNNNN NNNNNNNNNN NNNNNNNNNN
29651 NNNNNNNNNN NNNNNNNNNN NNNNNNNNNN NNNNNNNNNN NNNNNNNNNN
29701 NNNNNNNNNN NNNNNNNNNN NNNNNNNNNN NNNNNNNNNN NNNNNNNNNN
29751 NNNNNNNNNN NNNNNNNNNN NNNNNNNNNN NNNNNNNNNN NNNNNNNNNN
29801 NNNNNNNNNN NNNNNNNNNN NNNNNNNNNN NNNNNNNNNN NNNNNNNNNN
29851 NNNNNNNNNN NNNNNNNNNN NNNNNNNNNN NNNNNNNNNN NNNNNNNNNN
29901 NNNNNNNNNN NNNNNNNNNN NNNNNNNNNN NNNNNNNNNN NNNNNNNNNN
29951 NNNNNNNNNN NNNNNNNNNN NNNNNNNNNN NNNNNNNNNN NNNNNNNNNN
30001 NNNNNNNNNN NNNNNNNNNN NNNNNNNNNN NNNNNNNNNN NNNNNNNNNN
30051 NNNNNNNNNN NNNNNNNNNN NNNNNNNNNN NNNNNNNNNN NNNNNNNNNN
30101 NNNNNNNNNN NNNNNNNNNN NNNNNNNNNN NNNNNNNNNN NNNNNNNNNN
30151 NNNNNNNNNN NNNNNNNNNN NNNNNNNNNN NNNNNNNNNN NNNNNNNNNN
30201 NNNNNNNNNN NNNNNNNNNN NNNNNNNNNN NNNNNNNNNN NNNNNNNNNN
30251 NNNNNNNNNN NNNNNNNNNN NNNNNNNNNN NNNNNNNNNN NNNNNNNNNN
30301 NNNNNNNNNN NNNNNNNNNN NNNNNNNNNN NNNNNNNNNN NNNNNNNNNN
30351 NNNNNNNNNN NNNNNNNNNN NNNNNNNNNN NNNNNNNNNN NNNNNNNNNN
30401 NNNNNNNNNN NNNNNNNNNN NNNNNNNNNN NNNNNNNNNN NNNNNNNNNN
30451 NNNNNNNNNN NNNNNNNNNN NNNNNNNNNN NNNNNNNNNN NNNNNNNNNN
30501 NNNNNNNNNN NNNNNNNNNN NNNNNNNNNN NNNNNNNNNN NNNNNNNNNN
30551 NNNNNNNNNN NNNNNNNNNN NNNNNNNNNN NNNNNNNNNN NNNNNNNNNN

FIGURE 3I

30601 NNNNNNNNNN NNNNNNNNNN NNNNNNNNNN NNNNNNNNNN NNNNNNNNNN
30651 NNNNNNNNNN NNNNNNNNNN NNNNNNNNNN NNNNNNNNNN NNNNNNNNNN
30701 NNNNNNNNNN NNNNNNNNNN NNNNNNNNNN NNNNNNNNNN NNNNNNNNNN
30751 NNNNNNNNNN NNNNNNNNNN NNNNNNNNNN NNNNNNNNNN NNNNNNNNNN
30801 NNNNNNNNNN NNNNNNNNNN NNNNNNNNNN NNNNNNNNNN NNNNNNNNNN
30851 NNNNNNNNNN NNNNNNNNNN NNNNNNNNNN NNNNNNNNNN NNNNNNNNNN
30901 NNNNNNNNNN NNNNNNNNNN NNNNNNNNNN NNNNNNNNNN NNNNNNNNNN
30951 NNNNNNNNNN NNNNNNNNNN NNNNNNNNNN NNNNNNNNNN NNNNNNNNNN
31001 NNNNNNNNNN NNNNNNNNNN NNNNNNNNNN NNNNNNNNNN NNNNNNNNNN
31051 NNNNNNNNNN NNNNNNNNNN NNNNNNNNNN NNNNNNNNNN NNNNNNNNNN
31101 NNNNNNNNNN NNNNNNNNNN NNNNNNNNNN NNNNNNNNNN NNNNNNNNNN
31151 NNNNNNNNNN NNNNNNNNNN NNNNNNNNNN NNNNNNNNNN NNNNNNNNNN
31201 NNNNNNNNNN NNNNNNNNNN NNNNNNNNNN NNNNNNNNNN NNNNNNNNNN
31251 NNNNNNNNNN NNNNNNNNNN NNNNNNNNNN NNNNNNNNNN NNNNNNNNNN
31301 NNNNNNNNNN NNNNNNNNNN NNNNNNNNNN NNNNNNNNNN NNNNNNNNNN
31351 NNNNNNNNNN NNNNNNNNNN NNNNNNNNNN NNNNNNNNNN NNNNNNNNNN
31401 NNNNNNNNNN NNNNNNNNNN NNNNNNNNNN NNNNNNNNNN NNNNNNNNNN
31451 NNNNNNNNNN NNNNNNNNNN NNNNNNNNNN NNNNNNNNNN NNNNNNNNNN
31501 NNNNNNNNNN NNNNNNNNNN NNNNNNNNNN NNNNNNNNNN NNNNNNNNNN
31551 NNNNNNNNNN NNNNNNNNNN NNNNNNNNNN NNNNNNNNNN NNNNNNNNNN
31601 NNNNNNNNNN NNNNNNNNNN NNNNNNNNNN NNNNNNNNNN NNNNNNNNNN
31651 NNNNNNNNNN NNNNNNNNNN NNNNNNNNNN NNNNNNNNNN NNNNNNNNNN
31701 NNNNNNNNNN NNNNNNNNNN NNNNNNNNNN NNNNNNNNNN NNNNNNNNNN
31751 NNNNNNNNNN NNNNNNNNNN NNNNNNNNNN NNNNNNNNNN NNNNNNNNNN
31801 NNNNNNNNNN NNNNNNNNNN NNNNNNNNNN NNNNNNNNNN NNNNNNNNNN
31851 NNNNNNNNNN NNNNNNNNNN NNNNNNNNNN NNNNNNNNNN NNNNNNNNNN
31901 NNNNNNNNNN NNNNNNNNNN NNNNNNNNNN NNNNNNNNNN NNNNNNNNNN
31951 NNNNNNNNNN NNNNNNNNNN NNNNNNNNNN NNNNNNNNNN NNNNNNNNNN
32001 NNNNNNNNNN NNNNNNNNNN NNNNNNNNNN NNNNNNNNNN NNNNNNNNNN
32051 NNNNNNNNNN NNNNNNNNNN NNNNNNNNNN NNNNNNNNNN NNNNNNNNNN
32101 NNNNNNNNNN NNNNNNNNNN NNNNNNNNNN NNNNNNNNNN NNNNNNNNNN
32151 NNNNNNNNNN NNNNNNNNNN NNNNNNNNNN NNNNNNNNNN NNNNNNNNNN
32201 NNNNNNNNNN NNNNNNNNNN NNNNNNNNNN NNNNNNNNNN NNNNNNNNNN
32251 NNNNNNNNNN NNNNNNNNNN NNNNNNNNNN NNNNNNNNNN NNNNNNNNNN
32301 NNNNNNNNNN NNNNNNNNNN NNNNNNNNNN NNNNNNNNNN NNNNNNNNNN
32351 NNNNNNNNNN NNNNNNNNNN NNNNNNNNNN NNNNNNNNNN NNNNNNNNNN
32401 NNNNNNNNNN NNNNNNNNNN NNNNNNNNNN NNNNNNNNNN NNNNNNNNNN
32451 NNNNNNNNNN NNNNNNNNNN NNNNNNNNNN NNNNNNNNNN NNNNNNNNNN
32501 NNNNNNNNNN NNNNNNNNNN NNNNNNNNNN NNNNNNNNNN NNNNNNNNNN
32551 NNNNNNNNNN NNNNNNNNNN NNNNNNNNNN NNNNNNNNNN NNNNNNNNNN
32601 NNNNNNNNNN NNNNNNNNNN NNNNNNNNNN NNNNNNNNNN NNNNNNNNNN
32651 NNNNNNNNNN NNNNNNNNNN NNNNNNNNNN NNNNNNNNNN NNNNNNNNNN
32701 NNNNNNNNNN NNNNNNNNNN NNNNNNNNNN NNNNNNNNNN NNNNNNNNNN
32751 NNNNNNNNNN NNNNNNNNNN NNNNNNNNNN NNNNNNNNNN NNNNNNNNNN
32801 NNNNNNNNNN NNNNNNNNNN NNNNNNNNNN NNNNNNNNNN NNNNNNNNNN
32851 NNNNNNNNNN NNNNNNNNNN NNNNNNNNNN NNNNNNNNNN NNNNNNNNNN
32901 NNNNNNNNNN NNNNNNNNNN NNNNNNNNNN NNNNNNNNNN NNNNNNNNNN
32951 NNNNNNNNNN NNNNNNNNNN NNNNNNNNNN NNNNNNNNNN NNNNNNNNNN
33001 NNNNNNNNNN NNNNNNNNNN NNNNNNNNNN NNNNNNNNNN NNNNNNNNNN
33051 NNNNNNNNNN NNNNNNNNNN NNNNNNNNNN NNNNNNNNNN NNNNNNNNNN
33101 NNNNNNNNNN NNNNNNNNNN NNNNNNNNNN NNNNNNNNNN NNNNNNNNNN
33151 NNNNNNNNNN NNNNNNNNNN NNNNNNNNNN NNNNNNNNNN NNNNNNNNNN
33201 NNNNNNNNNN NNNNNNNNNN NNNNNNNNNN NNNNNNNNNN NNNNNNNNNN
33251 NNNNNNNNNN NNNNNNNNNN NNNNNNNNNN NNNNNNNNNN NNNNNNNNNN
33301 NNNNNNNNNN NNNNNNNNNN NNNNNNNNNN NNNNNNNNNN NNNNNNNNNN
33351 NNNNNNNNNN NNNNNNNNNN NNNNNNNNNN NNNNNNNNNN NNNNNNNNNN
33401 NNNNNNNNNN NNNNNNNNNN NNNNNNNNNN NNNNNNNNNN NNNNNNNNNN
33451 NNNNNNNNNN NNNNNNNNNN NNNNNNNNNN NNNNNNNNNN NNNNNNNNNN
33501 NNNNNNNNNN NNNNNNNNNN NNNNNNNNNN NNNNNNNNNN NNNNNNNNNN
33551 NNNNNNNNNN NNNNNNNNNN NNNNNNNNNN NNNNNNNNNN NNNNNNNNNN
33601 NNNNNNNNNN NNNNNNNNNN NNNNNNNNNN NNNNNNNNNN NNNNNNNNNN
33651 NNNNNNNNNN NNNNNNNNNN NNNNNNNNNN NNNNNNNNNN NNNNNNNNNN
33701 NNNNNNNNNN NNNNNNNNNN NNNNNNNNNN NNNNNNNNNN NNNNNNNNNN
33751 NNNNNNNNNN NNNNNNNNNN NNNNNNNNNN NNNNNNNNNN NNNNNNNNNN
33801 NNNNNNNNNN NNNNNNNNNN NNNNNNNNNN NNNNNNNNNN NNNNNNNNNN
33851 NNNNNNNNNN NNNNNNNNNN NNNNNNNNNN NNNNNNNNNN NNNNNNNNNN
33901 NNNNNNNNNN NNNNNNNNNN NNNNNNNNNN NNNNNNNNNN NNNNNNNNNN
33951 NNNNNNNNNN NNNNNNNNNN NNNNNNNNNN NNNNNNNNNN NNNNNNNNNN

FIGURE 3J

34001 NNNNNNNNNN NNNNNNNNNN NNNNNNNNNN NNNNNNNNNN NNNNNNNNNN
34051 NNNNNNNNNN NNNNNNNNNN NNNNNNNNNN NNNNNNNNNN NNNNNNNNNN
34101 NNNNNNNNNN NNNNNNNNNN NNNNNNNNNN NNNNNNNNNN NNNNNNNNNN
34151 NNNNNNNNNN NNNNNNNNNN NNNNNNNNNN NNNNNNNNNN NNNNNNNNNN
34201 NNNNNNNNNN NNNNNNNNNN NNNNNNNNNN NNNNNNNNNN NNNNNNNNNN
34251 NNNNNNNNNN NNNNNNNNNN NNNNNNNNNN NNNNNNNNNN NNNNNNNNNN
34301 NNNNNNNNNN NNNNNNNNNN NNNNNNNNNN NNNNNNNNNN NNNNNNNNNN
34351 NNNNNNNNNN NNNNNNNNNN NNNNNNNNNN NNNNNNNNNN NNNNNNNNNN
34401 NNNNNNNNNN NNNNNNNNNN NNNNNNNNNN NNNNNNNNNN NNNNNNNNNN
34451 NNNNNNNNNN NNNNNNNNNN NNNNNNNNNN NNNNNNNNNN NNNNNNNNNN
34501 NNNNNNNNNN NNNNNNNNNN NNNNNNNNNN NNNNNNNNNN NNNNNNNNNN
34551 NNNNNNNNNN NNNNNNNNNN NNNNNNNNNN NNNNNNNNNN NNNNNNNAAT
34601 TAGCTGGGTG TGTTAGTGTG CCTGTAATCC TAGCTACTTG AGAGACTGAA
34651 GCAAGAGAAT TTCTTGAACC CAGGCAGATG GAGGTTATAG TGGGCTGAGA
34701 TCTCACCACT GCACCCCAGC TTGGGTCACA GAGTGAGACT CCGTCTATTT
34751 AAAAAAAATT AAATCTTCAT ATTTTAAACG TTTATTTGAA AATTTGATTA
34801 TATACTTTGC TATAAAATGC TAAATAATTT AGGAGTGTTT TGGAATCCTT
34851 TGAGACAGGG TAAATGTGTC ATGTTTATAT GCTTAAAAAA TAAGATGTTT
34901 TTCATTCCAG ACTAGAGTTT ACTCATTTTC CTTATTCTTA GGTCATCTGA
34951 ATAGCTTTAT GCTTATATTT TGTATAAAAT TTTCTGAGGT TTGTAATCCT
35001 GTTTAAACAC ATATGAAAAC ATCGAGGTTC AGTCATACAA AATTACAGTC
35051 ATAGATGTAA TTTGGCTTTT TGGTCTATGT AACTTAACAC AGTAACTGCT
35101 TTTTTTCCAG TACAATTTGA AAAAAGTGGA AATTTCCTAG GGGAAAATAT
35151 ATGCTTATCA AAAGTTAGAG CTGTCTTCTG GAGCAGCCTT CAAAGCTGAA
35201 GTAAATAAGA CATGAAGTTT AGCTTCCAAG CAGGCTTTAA TTTAGAAATT
35251 GCTGACCAAA TAAAAATGTC CATAGCCTTT TGTCATAAGG TTTGTTGATT
35301 ACTTTGGTCC AGTTGAGCTG ATTAGGTCTT AAATATTATA AAACTCAAAG
35351 GTAATAGCAT AAAAAGTGCC AGTTTAAATA TTTTATTGAT CAGTAGTAAT
35401 GTGGATGATT CTGACTTGGT ATTTATTCAT TAACACTGTG GGAGTTTGGG
35451 CAGTAAGATG GGACTCTTAT AAAATCAATT TAATTTAAAA TCAAGTTTTA
35501 CAGTATTTTA TTTCTAGAAT TCTAAATAAA TATATAGAGA ATTATTTTTG
35551 GGCTTTGTGT CAGGAAAACT TCCATATAAC GTCATGTTAA CTTTTAAGTC
35601 TTGCTGTGTT AATTTTTTAT AGTTGCTTGG TAGAATCCTT CAGTGGGAAA
35651 CCAGGAGAAT GCAGGATCCC TTCAAAATGT CAAATCTTAG AAATTACTTT
35701 TCTTTCACTC TTCTAGCACT ATAAGCTGCT CTTATTTCTC TTATTCTTAA
35751 ACTTTCCTAT TCTTTTGTCA TTCACAAGAT CAGAGAGGCC TTAGGCATAG
35801 TGGTTAGGAA CTTGGGCTTT AAGGCCCAGC TGGCTGGACT TAAATTTAAA
35851 TGGTCCTGCC TCTCACTAGC TGTGCTGACT GGAGGTTCTT TACCTCTTCA
35901 GGACTTTGAT TTCTCAACTG GTAAGGTGGG ATTTGTAATA AGGCCGTTAA
35951 AAAAATAAAT TTGAAATAAA TAATAAATGA GGTAATGCAC TTAGAGCATG
36001 CTTAGCAGAG TGCCTGACAT ACAGGAATCA TTCAAGAATT GCCAGCTAAA
36051 ATAATTATAT TACGTTACAG GATTTTAGAA TGAGATTCAT AAACTGAGAT
36101 GAAATTCCAA GCTCAAGAAC AATATATGGG TGCCAGTACT TACAAATTTT
36151 AAAGTGAGTC ACTAGACTGT TCCTGTATAG CTCATAGTTA AAAGTTTTTA
36201 AAAACCTATC TTTCCAGCAT TAGAGATGTC CAGTTTCAAC TATTGTAAGT
36251 GATTTATTTT GGGGAGATTG GAAGGAGCTG TGGTTTGGAG TGGAGAAGGG
36301 CTACTTTAGT GCAGGGGACA TTAAGGGGAT GAATTCAGAG TTTAATTCAT
36351 GTTTGCTGTA ATTTGGGGAG CATGAGGATG TGAGAGTTTG TAGCTAGGTG
36401 GCCTGAGACA GGAGAGCAGA GTCAGAAGCT GGACTGCACC AGGAGATAGC
36451 CCAATAATTA GCGCTTAGGG GTCGGAGGTA CATATTTCAT CGCCTGGAAG
36501 TGCGCCATGA AGAAAGGAAC TGTCCTAGAA GCCTTTAGAA AGGGTACTGT
36551 CTCAAATGCT CAGATGGCTT CCTGGTGGCA TGATGTGATC TTAAGACGTG
36601 AGGAAGAAGT TGAAAATGAC TAATTGGAAG AGGCACAAAA CTGGAATTTT
36651 CCAGCAGAAT TTTCTTAAGG TGGTCACGTA AGAGAGAGTC AGCTTTGACC
36701 ATCTTCCAGT TCACCCATCT CACTGGCTTG ACTTTGGTGA GTGGCAGATT
36751 ATGAACAGAA TCTGAAGACA TATTCTTTCA CACTGCAAGG TTTCAGGTTT
36801 TAAGCAAAAG CAAATTAGTG GAGAAAAGAA CAGAGTTGTA TGAATTTAGA
36851 ATTTTGTTTT ATTCTAGAGC TAAATAGTCT AAATTTTTGA AAGAGGACAT
36901 TTTATGACTA AGAAGGCATG GAAAATTAAT GTTACTATCA GATTTCATTG
36951 GAAGATGGGA TAAAACTAGC TCACAGAGAT TTTTGTAAGT AAAAGTGGCA
37001 GAAAATAAAA TTACATAAAA ATATACATAA ATAAAACAAA TGAAAATGCA
37051 AAACATATAT TAAAATAATA TTAAAATTCA AGTATTTTAA AAATAATTAT
37101 CACTTAGTAT AATCAAATAT GCCATTAACA ACTATGTGAT GTAGTTAGAG
37151 GAGATATATT CTATGTCTTG TTTCCCCCTA CCAGCATGAG TGCTAATTAA
37201 GAATATGGAA TTATTATGCC ATGGTGGGAA AGGCAGTGTG TCTGGGGACA
37251 ATTTAGTGGA TTTTAAACTG GTGCTAATGC TAATTATCTG AGTGATCTTA
37301 AGTAAGTTTC CTAATCTTTC CAGGGTTCCC TATTCCTCAT CTTTAAAAGA
37351 AGGTTATTTT ATATTATTCA GAAAGTAACA GTATGGATCT GAGTGACTAT

FIGURE 3K

37401 AAACTCCAAT AATAAAGAAA TGTAAAGGGA ATATAAACAA ATGTATGCAA
37451 AGTTTCCAAT TAGAAGCAAA ACTGGACTTA AACAGGTTAA ATATATTTAG
37501 AGGATGAGAA TTTACTGTGG CCTTGATCAG TTAGTATAAT TTTTTACGCC
37551 AAGGCTACCA TCATTTCTCA TCTGGACTCT TAGAATAGCT TTCTGATAGG
37601 ATACTGTGCT AGGTTCTAGA AAAATTGGTG AACCAGGTGA CTAAGGTCCC
37651 TAAACATATG AAACAGTCTT TCCTGGGAGA TAAATCAATA GTTACAATAA
37701 AGTCATGCCT TTTGATTGTG GAATGTGCAT TAGTTTAAGG AGACCCGTTA
37751 AACTTGCCAC TTCCCCACCT GGTGAAAGAT ATCAGAAGAT GCTTCTAACA
37801 GGCACTGTCA TTTAAGCTGA GCCCAAGGGT GAGTAGGTAG TCACTGAGAT
37851 GAGAAGATAC TAGCTTATGG AAAGGCCCAA AGAATTTGAT GTTTTTCATA
37901 ACTTGAAATA AATTTAGTAC GGCCTGGAGT GCTGCGCTTG AGGGATGGAA
37951 TGGTGAGAAA AAAAAACGCT TGCAGGATGA AAACCAAGAT CTTGCAGGGA
38001 CGCAGAAGCG TCATGTTGGT CCCTTGAGAG TTGCTCAGAG TAGTTGTTGA
38051 TTTTAGGTAA TACTGGAGAA ATATCGTCTT TAAGAGAAAT GTAGGGAAAG
38101 TCTTAATGAA TAAATACAGT ACATATTTGC AAATTGTGTT TTGTTTTTTT
38151 GAATTGACCA GATGTTTTAG CTCAGTTTCA TCATTATTAA TGGTGATATG
38201 GTAGGACCAT TTCAGTACAA TGTGTGATAT TTTGGAGTTG ATCTGGAGCA
38251 ACTGGAGTTT TAAATTTCTA AGAAAAGAAT GGAAATGCCT CTTTTTCTTA
38301 AGGTGAGTCC AGTGCTACAT CAAGAGGGTG TTTGGGCCAG GTGCAGTGGC
38351 TCATGTCTAT ATTCCCAGCA CTTTGGGAGG CTGACCTGGG CGGATCACTT
38401 AAGGCCAGGA GTTCAAGACT GGCCTGGCCA ACATGGTAAA ACCCCAGAGG
38451 CTGAGGCATG AGAATAACTT GAGCCCAGAA GGCAGGGGTT GCAGTGAGCT
38501 GAGATGGCAC CATTGCACTC CAGCCTGGGT GACAAAAGCG AGACTCTGTC
38551 CCAGAAAATA ATAATAAAAA AAGTGAAGTT TAATCTTCTG GACAGGATAA
38601 GGTCAAAATT GTCTCCATAA GTTCCTTTAT AAGTTTAGAT CCGTTTGCTA
38651 GGTGTTCTCA GTTACCTTGG TTTTCAGAAT TGTACATAGT ACAGTATCTT
38701 ACTAAGTTTT TGAAGTATCT TATCCAAAAA AAAAAAAAAA AAAACTTCCT
38751 GGTGTAAAAA TGGCTTGCTC CCCTTCAACC TGTTGCCCTC CACTCCATAT
38801 TTATTTGAGT GTCCCCTGCA GTTATTGGGT GTAGAGTACT TAACAGATGA
38851 TTGACAAAGG TGATGAGGAG ATGCAGATGC AGATAATAAC TGCATCTGTT
38901 GGTGTTTCTC ACATAAATAG CTTCCTCACC TGGGATTGGG ACCTTGGACA
38951 GAAGTATTCA GCTAATAAGA TATTCTTATA GTTGCTTTAT ACATTTTCTT
39001 TGAGGTCCCA AACTTTTTAA AGATAATATC ATCCATTTCT TTGTAAATAA
39051 GGTGACTAGG ATATAACTGT CCTTATATCA GAGGATATAC CAGATAATTG
39101 CTACTTACCC CGTGGTCAGA GTAACCTATG TCTTGTTCAT GTCATTTTGA
39151 CTTCCGCATT CAGAAAAGAG AGGACTCTTC AGCCAGCAGT AATGTGCAGT
39201 CTTGGCCTAT AGAGGCTTCC ATACCTCCAT ATATTCACAG TTTGCTCCTC
39251 TAAGGCATAA AGGCATATTA TCAAAATGTA TAATTACAGC TTGAGAGCAA
39301 TAATAGGTGT AAAGGTTTTT CAATATTTTG TTTTATTTTC TGAGGTTTCA
39351 ATAGATCTAG TATCTAATAG AACAGAAACT TTACAGAAAT ATTGAATTTA
39401 TATGAAAACC CAACCAAATA GGAGGTCTGT AGAAGGTATC GTTCTAGCCA
39451 CTTCAAGATG GAAGTGTCTA ATCAGTGGGA TCCCTATATT TAACTTCAAA
39501 GATGTTATAG CCACAACTAT AGCTCTTTTT AAATGCTTTT AAATGCCATT
39551 TGATGTTTTT TTTTCCCCTC ATTCTCCAAA CTCAGTGGCC ATAATGCATT
39601 GACTGTTTCT GTGTGGAGAG CACCATCTGA TTTGTTTTAT TCTGAATAGA
39651 TAGTGCTTCT TTTTCATAGG TTTTTAAAAA ATAATTGAAA TAGTCTTGAG
39701 TGGATTCTTT CAGATTAGTT ATATGTAGGT ATATATACAT ATATATAAAG
39751 AAAACTAATA TGAATACATT AAATTCTAAA ATTAATAAAA TTTATTTTGC
39801 TTTAGTTGTT TAAACTCCTG AATCATTATA ATTTCCTTTT AATCATTTTT
39851 TTTTCCTGCT CTTTTTCCTT CCCTTTATGA TCAGGATTTC AAGTTTATTA
39901 TTGTGGCTTT GTCAGTGCTT TGACCCTACT CTAGTAACTT CCTTTGACAC
39951 AATGTGATAC AAACGCATGA AGTTGATGTT ACTATTTATT GTTTTTAGAA
40001 CATTGGATTT ATAAAATCAC AGGGACTTAG CTATTCCCTC TCCAATGTAC
40051 TCTTCTCAGT ATTTTGCAAC TACTTAAAGA TTTTCTTATA GTTGCTTTAT
40101 AAGAACTCTT CAGAGCCAGA ATACTTAAAG TATTCTGTGT TTTTTGTTTG
40151 TGTTCTCTCA GTTATGTGTA TCTAGTTATT ATAAATTCCT CACCTACTCA
40201 TAATTGTGAT ATTTTATATA TTTTCCAATT CATTATTATA TAATTTACAT
40251 CATGGATCTA AAAAAAGATA TATAGAATAC TTCAACTCTG TTTAATCATG
40301 ACTTTTTTTT TTTTTTTTTT GAGATGGAGT CTCGCTCTAT CTCCCAGGCT
40351 GGAGTGCAGT GGCACAATCT CAGCTCACTG CAACCTCTGC CTCCTGGATT
40401 CAAGTGATTA TCCTGCCTCA GCCTCCCAAG TAGCTGGGAC TACAGGTGCA
40451 CGCCACCACA CCCAGCTAAT TTTTGTATTT TTAGTAAAGT CGAGATTTCA
40501 CCATGCTGGC CAGGATGGTC TCAATCCGTT GACTTTATTA AGAGATTTTT
40551 CTATAAGCCT GAAATCTAAA TTAGATTTAT AGCACTTATC ATAATATATA
40601 ATTATATATT TACTTTATAC TTTCTGTTTT CTGTTTTTCA CATGAGATTG
40651 TAATCACCCT GAAGGCAAAG CCTATGTTTA TTTTGATCCA ACTTTATACA
40701 TAGAACCTAG TGGATTGTTT TTATATATGT ATATGTGTGT GTGTAAAAAA
40751 AGAAATATAC ATTCATAGCA AATATTTTTG GAGTTTTGTA AATGAGAAGA

FIGURE 3L

40801 AGAAATTTGA AGAGAAAATG AGTTTTGAAC AGAAAATGGA GAAATCAGAT
40851 TTTCATTTCA GACAGACCAC TGAGGCTGCA TTGAATTCAA TGAAAGGAAC
40901 AAGATGAAGA GACCCTAGTT GAGTTAAATG GAATTGGTAG GGGTTAGAAA
40951 GTCATATATT TGAAGGTGAT TTAAAAACCT TACTGTATTT GTTCTCTATT
41001 ACTGCTGTAA CAAATTACTA CATATTCAGT GGTTTAAATA ACACACGTTT
41051 ATTTGCACAG TTTTGTAGGC TAGAGGTCTG ACATGGATAT CCCTAGGCTA
41101 AAACCAAGGT GTTAGTGCAA CTGCGTTCCA TTCTGGAGGT TCTAGGAGGT
41151 AATCCATTTT CTTGCCCTTT TTAATGTCTG GAGACCACCC ATGTTCCTCG
41201 GCTGCCTTCC TCTCTCTTCA GAGCCAGCAA TATTGCATTT CTGCCTTTCT
41251 TCTGGAGTCA CATCTTCCAC TAGTTCTCTG TCTCTCTCTT CTACTTTTAA
41301 GGACCTTTGT TATTACATCA GGCCCACATA AATAATATAA AATATCCCCC
41351 TATTTTAAGG GCGATTAGAA ACCTTAGTGG ATTAGCAACG TTAATTCCAT
41401 CTGCAACCTT AATTTTCCTT CTCCGTGTAA CAGCATATAC ATAGGTTCCT
41451 AGGATCAGGA TATGGACAAC CTGGGAGACA GACATATTAT TCTGCTTACG
41501 ACATCCAGTT TGCAAACTGA TAGATTTGTA GTTAATATTG AGGGATGAGT
41551 TAAGGATAGG ATATTGGTTC ACAATTTGTG TACTTGGGCA GATGCTGGGT
41601 AACAGTTACT GAAACAGAGA AATCAGGAGG TGGTGCCCAT TTAATGGGAA
41651 AACAGTGAGT TCAGATGTGA ACATGTTACA TTTGAGAGGC CTCCGAATTG
41701 TATCTGAAGC ATAGAGGGAA ATTTATGCTG GAGATACTAT TTTGGAGGTT
41751 GACAGCATTA AAATAATAGT TGAAATCCCT AAACTGATAA ATTTTCTTTG
41801 AAAATGAAAA AAAAAAACAG AGAAAATACA GAAGAGATTC CTGAAGAACA
41851 TAAAATTTTG CATTTTTCAA AATATGGCAG TTTTATGGAA TATGAAATAT
41901 GAGCAACTGA AGTAGAATAA AAATATTAAG ATAATTTACA CAGAAACTAA
41951 TTTTCATTGA TAAATCAATG GTTGTAAGTC TATACAACTC TTATTATTCT
42001 TCATCAGTAA AAATTAGAAC TGCAGTATAT TTACCTCTGT AAAAGGTAAC
42051 TTAAGACTTG GCCTGGGTGG CTTTCACCTG TAATCACAGC ACTTTGGGAG
42101 GCCAGGGTTG CATAAGGTCA AGGCTAAGGT GGCTCAGGAT CACTTGAGCC
42151 TAGGAATTCA AGATTAGCCT GTGTAACATG GGCAAACCCC ATCTCTAGAA
42201 AAAAGTGCAA ACATTAGCCG GGCATGATGG TGCACATCTG TAGTCCCAGC
42251 TACTTGGGAA GCTGGGGCAG GAGAATCACT TGAGCAGGGG AGGTGGAGGT
42301 TGCAGTGAGC GGAGATCGCG CCACTGCACA TCAGCCTGGG TGACAGAGGA
42351 GACCCTGTCT CATAAATTAA AAAAAAAAAT GGGCAGTTTA TGACAGAAGC
42401 AACCTGGCCA CCTAATATTG GACTCTATGC CTAAAATTTT AGCTTCTTCC
42451 TCAAATCATG GGTCATGGTC AGCAAATGTC ATTGTCCTTA TTTGAAAATA
42501 AAATCAATCT ATAGAATCAG AATTTTACTC ACATGTAAGA AACCTTGGAA
42551 AAAAAATATT GGTTTATAAA TCAAGTGAAT CTACAGATAG AACTATTTTT
42601 CTTTCCAAAA AATTAAGACT AGGCCTTCTA AAATTTAGCC AATAAAGGAT
42651 AGGCAATAAC TATGGGAACT ATAACATATT TTGCAAATAG TGTCTTAAAT
42701 ACTAGTGTTA TAGTTGGCAA TACCTATATT CGAAAATTAA TTCCTGTAAA
42751 TAGAAAATTT ATCTGTGTTT CTTCAGTGCT GTTCAAATTT AAGAGCTTTA
42801 AAATGGGTAG ATACAATCAT TCATTTATTA AGTGGAAATA GATCTAGAGG
42851 ATTTTTAAAA AGTAAAACAG GGTCACTCCT TTCTAGTAAT TTAGTACTCT
42901 TTAAGAAATC TTTATCTGTA ATTTGGTCTT TTGAATGGAT TTACCTGCAG
42951 GGAAGGAGGT TCCCTGGGGA GACAAATCAT CAGTGAATAA GTCAATCTCA
43001 TTTATAAATG AGTCTCCTGT ATGCCTGATT AACAAGAACC AGTCTCCTAA
43051 AATATGATTA TGCCTCTTTG GAAGGATAAA TATTAATCTT CTCAGTCACA
43101 AAAGCTAAGG ATTGAATTTT GAACCTGATT ATTTCACTTT GTCATCAAAA
43151 TATTAATAGT TTCGGAACAT TATAGATTTC ATTGCCATAA TCTGTATCTT
43201 GGGTAATCAA TAAGTTAAGA AAACTGATCA ATGTCTTATC AAACCTACAT
43251 TTGCTGTCTT ATGCTTAATT ATACTTAGGG AACCCATGTT GAATGAAATA
43301 TTTTCCATTT GCCTAGATGT TAAAATGTCT TTATCCTTTC TTTTGCATTT
43351 ACTTTATTGC AGAAAGTTCT GATGATAAAC AATTTGACAA TAGTACTTAA
43401 TGATTTGCTT CCCTACAGGG TAATGATAAT AATGCATTTA TTGTATTTTA
43451 TATTTTATGC CAACCATAAA GCTTCCATCT GTCATTCTTT TCTCTATATT
43501 GAAGCCATGC TGCTCTTGGC ATGGGTCACA TTTGTAAATG TTTCATTTAT
43551 GAACCATTCC TCCTCCTAAC TCCTCTGCAA TAGAGAAATA TGCCAAAAAA
43601 GATTAATTGC CTTATAGTTC ATGTGTCTCT AAATTTGGCA TCACATTCAC
43651 TGTGACATTT CCTCAGTAGT TTCCAGTAGG AATTTGTCCT ACATAATTCT
43701 CATGATTTTA TTTATCAAAT AATTGTGCTA AGAGCTGTTT AATGTGTAAA
43751 TGATATGACA ACTGGTTGTC TTAANNNNNN NNNNNNNNNN NNNNNNNNNN
43801 NNNNNNNNNN NNNNNNNNNN NNNNNNNNNN NNNNNNNNNN NNNNNNNNNN
43851 NNNNNNNNCA TAATTTTTAG GCAGTCAAAG ATGTTGAAAA TGTGGGAAAA
43901 TGATTAGAAA ATAAGATTTT CATTTAAATT ATTTTTGTAG CATCTCCTCA
43951 GAATGTATAT TATTGTGTCC GGTTTAATGA CCCAATAACC ATGTTTTGTG
44001 AGCAGGTGAC TGTGAAATCT GAATGTTCAG GAATAGAATT TAGTTGGCTG
44051 CTTGAAGAAT ATTGGCAGTT CAGCTCTACC TTTTTTAGCG TCTAAAGGAA
44101 CTAGAGTATA GGTAATATTT CAGAAATCAG CTGGAGAAAG GGGGTGGGGG
44151 AATCAAAGGA AAAAAACACC ATTGTTCTTA GATCTCTCTT GAATACTCGT

FIGURE 3M

44201 CAAGTGGATT AATTAACAAG AGAGACTCAA AAGTTGAAGA AGAGGCAATC
44251 ATGACCCATG ACACAGCAAG CAAATTTTTT TGTGTTACTC TTCTTGTCAT
44301 ATATAGGGTA GCCATGCTAC CCTAGTAGGG TGGCTAAGAA GATCAGAGTC
44351 TATTGAGAGC TAAGTTAGGG TTGATACTAC GCTTAGAGAA TTACATGGTT
44401 TAGGGTAGAG CAACACCCAG CAATTAGTAG AATAAGAAAT ATGACTTGAC
44451 CAAGCATACA GTATTAAAGC AAAGTATAGA ACCCAGGAAG CAGATAGGAA
44501 AAGATGTAAT CTAAACAGTG GGAAGTTTCT TGGGACATGA TAGAAGTTGG
44551 AGATTTAGGA AGTCTCTTTC AATATATTTC TGTGAAAAAT TGCTTGTGTG
44601 TCGTGATATT AGGTATGCCA TGAAAAAGTC CCAAGTCAGT GTTACCTGAA
44651 AGGCGCTGTT ATCAATTCAA ATTTAACTTG GATAAATAAA TAATGCAAAA
44701 GGGAAGAGAA GAAATGATTA TTCATAAGCA TATTTGTATG CTATTTCAGT
44751 TAAATTGTTT TCTTCGTATG ATGGATGTTG GTTATCAGAT AGTAGGGGGG
44801 ATAATTTGAA CACTGTACAC AGTCAGAAAT GGGGATAGAT GTCCAGGGTT
44851 TGGACTGAGA GTGAGCAGTC TGAGGGCAGT CAGTGCTTCA GGGGTTGGGG
44901 CCAAGCTGGA GCAGAGAAGA CGACTCCAAA AGATACAAAT GTGTGTTTTG
44951 TCATAACCCA TTCTGTGCTC AAAACAAATG TCCACTTCGA TTTTATTTTT
45001 TCTAGAGACC ACTTTGCCTC TTAACTACAT CTCAGAAGAT CATATGTAAA
45051 TAGGCCTTGA CTTTTTCCAT CGCAAACCAA GTACAGTAGC CGTTTAAATT
45101 TTATCCAGCA CCTGCCTTCC TGCTTACACT ATACTGCTTT TCCAATAGTT
45151 GGTTAAGAAT GTTCTTTTCT AAGACATACA TTTCTTGCTC ATGATCCCTT
45201 TTGATTACCT CATTCATTCA TTCATTTTCT TCAACAGATA CCCACAAACA
45251 CCCCCCCAAC ACACACTCAC ACACATGTTA AAGTAATAGT TATAATTGTG
45301 CTGTCTTGAT TTGGCTGTAA TGTCAATGGA CAAAAGAATT CTTTAATTTT
45351 AAGTTGTTTA ATATGTATTT GTTTCAAAAT TATGGCAGCA CAATTAAAAT
45401 TTTTATCTGA TAATTTCTTA TTTCTGATGA CTAAAGGTTA GATTACTAAA
45451 GTGTTTACCT CTGATAATGG TTAATTTTTT TTTTTTTTTT GAGACAGGGT
45501 CTTGTTCTGT CACTCAGACT GGAGTGTAGT GGTGCAATCA TGGCTTGCTG
45551 CAGCCTAGAA CTCCTGGGCT CAAGCGATAC TCTCATCTCA GCCTCCTGAG
45601 TAACTGGGAT TACAGGCACA CACAACCACA CCTGGCTAAT TTTAATTTTT
45651 TAATTTTTTA ATTTGTAGAG ATAGGGTCTT GGTATGTTGC TTAGGCTTGT
45701 TTAATTCATT TTTAAAACAT CTCCCACTCT ATGTAAAACA ATATCTCTTT
45751 GGACAAATTT AGCAGACATT TCCTGTATTT GGGATTGTTT TGGAGAGTAT
45801 CCTACAGGTA GGAAATTATT TCCCTTTCTG TTGTCTACTG GGATGCATTT
45851 AGTCCTTGGC ACATTTATGA AAAGTGTGAT AAGTGGTACA ATTACTGACA
45901 ATTTTGATGG TGATTTTGAA GATGTGATAT GGGATGTCTG NNNAAATGAG
45951 GGCATTTTAA TCTGTTCCTG CTATATATGC TATAAACTAT GGCATGTGAG
46001 TTGACACAAA AATCCCTAGT AGTGAAAGTT AAAGTAGAAA ACTGGTACAC
46051 CTTGAAAGGT AGGCATTGTA ACTTACAGAC TTTCTATATC CTATAGCGTC
46101 CAATATATAG AGTTTAAATA TAACAGAGAC TTAAGAAATG TTTGTTGAAA
46151 TAACATCAAA ATGTATGATG TAAAATCAGG TAACATTTCT TGACTGCTTA
46201 GGTCCTAGTT AGGGAAGTTA ACATCTATTT TCATTATGTC CATGTAAATG
46251 TAATGGAGGG AACAAACAAA ACTGCAGGAA GAAAAATTTT CCCATCTTCA
46301 AGAAAAAAGA CTAAACTTTC ATTCTCATAA TTTTTTTCAC AGACTCAAAG
46351 TTATTTTTTT CCTTTCCAAT ATAAAGCCAC TGTTATTTTT TTTTAAAGTA
46401 ACGGTTTCAG TAGTTTCTTT TAGACCTTTC TTCCATTATA TAGAAATGGT
46451 TTTGGATTGA GATGGCCATT ATATTGTAGA TATAACTTAC AAGTAAGCAG
46501 TTATAATCTC TTTTATCAGG ACCATTAAAC CAATGATTTA AGTGTATTTC
46551 AGACCTTAAG TTTCATAATA TTCTTCAAAA AATTGGAAAA TGTCCAAAGC
46601 CCATAAAAGA CTAGTGGGAA CATAAGAAAG GTTAGAACTA GAAAGGCAAG
46651 ACACATGTTT GATGCTGTGT AAGCAATGGG GAACATGTTC AATGGTTTGA
46701 GCTAAATGGG GCACTTCTTT GTGAGAGATG AGAGACTCGC AACATTTATT
46751 AAATATAAGA CTAGAAAATC TAAGACTATA GCCAAATAGT CTTTTCTACC
46801 TATTTAATCC CTGAGTAATT GAGACAAATG TAAATAATAT AGGTCTCAAC
46851 TGAATTTGCT TACGAAGTGC TGAAGATGTC AAAATAGAGG AAGCATCTAA
46901 TTGCTATTAA TTAGGGACAT GCCAAATTTT CTTTTACTCA TTTTTAACCA
46951 CACAGATAAC AGAACAATTT TATAGGAAAG CACAACTTTT GAGGTAACTC
47001 ATTAATAAAT ATCAATGACC TTGCTCAGGA GCCCAGGAGG GAACCTGTAG
47051 TTTGGTGACC TTGTGATAGA TCACATCCAC ACCCGAGTTA TCCTTTGGTC
47101 TCTGTGGTAA GTGCTGGTAA TAGCAGGTTT TAGGAATGAT TATAAGGCTG
47151 AAGCAAATAT AGCTCTGTCA GTCAGGATAA GGATCTGGAG GTTCTTGGAA
47201 TGAGTGAAAT AAGAAGGTAT GAAAGTCAAG ATGAACATTT CTAGTAATAT
47251 TTTAATCAAC TATTAACCAT TCATTATTTG GATAAGGTTT TCAGTGATAG
47301 TTCTTGCTCT AGAGTATAAC TTGCTTTCTA AGTAATAGCA AACTGCTTCA
47351 CTTGATTTAT CCTGAAAGTA ATTTAGTTAG GTAGAAAATT ATATAGCTTG
47401 AGTGTTTTGC CCTTTTTTTT CTATTTAAGA TAACAGTGAA GAAAAGTAAT
47451 TTTTTATTTT TATACCTTAT TTTAGTAACT AAGGGAATCA TCTATTTTTA
47501 AGAAGGGACA GAGATATTTG AATGTTTTCT GAAAAAGATA CTCTCTAGCA
47551 GAGTAGAAAA CTGAAAGGTG TAATTTCAAA AGTTCTAGAC TTGATTTTAT

FIGURE 3N

```
47601 TCTCTAATTA GAAAAAGCTA ACATCACTAT GTTCATATTA CCTTATACTT
47651 ACAAATAGAA TTTCCAATCT CAGATGTAAC TGAAGGGATA GATAAAATTA
47701 AAATAATGAA CACCCTCTAT GTTAAAAACA TGGAAACAAG CAAAAACCAC
47751 AAAAAATAAG AATAACCACC ACAACAAAAC AAAATGCTGT AAGTACACCT
47801 ACTAAACAAA TAATTGATCT CAGGTTCTAG ATAAAAGTAG CTTTGTTGTT
47851 TTTAAGAAAG TATGATCCTC TTTAGAAGAT TTTATCTTAA AATATTCCAA
47901 GTACAGAGAG GACCATACCA GGAGTCAACA TAATTCAGTG TTGATTTAAA
47951 GCAATCTATG TTAGATTTTT TTCAGAATTA AATATGGTTG CAACTCCGTG
48001 TGAGGGTAGT TACCCATATT ATATATATCT GAAAGTAAAA ATTTTTGGTT
48051 CTTACCTTTC AGAAATATAC AGTGATGTTA AAACTGGATT AATTTGATAA
48101 TCTAAATGTC AGTTTAAAGC ATTTAAACAG TATTATATTT AAATGGACTG
48151 CTTCTAAAAT GTAACGTATA AAGATACATG TTTGTTTATA TATCTATAAT
48201 TCGAAGTATT CTCTGATTGT ATCTGGTCAT GATGTTAGAA GTATTGTCTT
48251 TGTTTATTGG TGTTTTTTAA GAGCTATTGG AGGTAGTAGA GTGTTACAGT
48301 TAGTGGAACA TAGAACCATC ATAAACCTCT ACTGATGTGC TGTTACTGAG
48351 TGACTTAGTA ACTTTACTTA GTAACTCAGA ACCTTAAGCT GGGCCTTAAA
48401 GCTTCTAAAT TGAATGATTC TAGGAAGAAA CCCCTTACTT TTTTTTCATA
48451 AGGTTTGTTA GAGAAAGTTC TCAAACATGT ATTTATGATT GTCTGAACTT
48501 TAAAACATAT TGATAAATCT TTGGACTCAA TTTACATGAC ATTGACTTAA
48551 ATTTTTACAA CAAAATTATC CTAAAAGAAT AGCTACTTTC TTAGTGGCTT
48601 GATTTATCTC TTCCTTGTGT AATTTTTCAA AGTGATATAT GAATAAAATC
48651 TCATCCTTTT CTTACTGTGC TATCTGAATA AAGATGATCT TCTATTATAT
48701 ACTATAAATC AATATGCTAA TTGTTTTTAA ACTAATACCT TTTAGATTTA
48751 CTGAAATGAT GTAGATAAAG ACTTGATAAA ATATTTAAAG GCAAGAAGTT
48801 AATATTTAGC TTTTTATTCT TAGGTAATCA TAACTTTCAG ATTTAATCCA
48851 GTACTATTAA ATTTGTGTTT ATCATTTGAT ATTGTCTTTT AAAACATTAT
48901 GAAATTTTCT TATAATTTCC AAAAGCATGA ATAAAGGCAA CTCTAATACA
48951 CTAAAAGACA TGTTCAGAAA GAAATATAAT ATGCTGAAAA TTTTTTTCTA
49001 AAAGTTAATA GGAAAATTGT ATGCAGTTAC ACAGACACAT TCTATGCATT
49051 ATGTTGCTTA CAAAACAAAA TGTGTATTTT TAGAACTTTA TTTTATTGCC
49101 CCCAGGCTAT TTTTTTTGTT TTATTCAATT TCTCAATTTA TGCTATGAAT
49151 AAATAATTGT ATTTTCATTT GTACTCTTTA CATAAATAAT AGGTGTTAAT
49201 CTTCCTATTT AAACATTGCT ATTATATTAA AAATGGAAAA GTATTGGCTT
49251 TTTTACTGAT GTTAATGCTG ATGTAATTTT TTTTCTTCCT ACTGAGTTTA
49301 CAGTGTTTGT TGCTGTCTGG TAGGGACTAG GTAACTTTTG TTTGGAGCCA
49351 GCAGGAGGAG CTCTCACCTT GCTGTGTTCA ACGTAATTAG TGTGCCTGAA
49401 AAACCTGAAT TTGTGGGGGT TTTGTATGTG AAACAAATGA TAAAATTAAA
49451 ATATTTACTA CATATCTCTA AAATTCTAAA TTTTATTTTA ATATTGAAAT
49501 ATAATTCACC TGTCTGAAAT GCAAATTTGG AATCTTATTT TTTTAAAGAA
49551 TTTTTAAGAG GTATCATTGC AATTTAATCA AATAAAGCAG TTAGGTCAAT
49601 CTTGTTTCTG GAAGATACTA AGAAACAACA AAAAATGTTT TCTAAGCATT
49651 TGCACTATAA TAGGTACATA CATATTTTCC TTTTTTACTT GTTTTGAAGT
49701 GAATATACTT CACAGTTTAC AACTATGAAT ACTGAGAACA AAGCAGGCTT
49751 AATATGTTTT AGAAACAATA ATTAAATGAA TTAATGAATT AACTTATTGG
49801 TCATAATTCC TATATAAAAC TTATAAAAAG GAAATAGCTG TTGATAGATT
49851 TCAATACGCA TTAGAGATTT TAGACACTTA GCTCTAATGA AAGCCTTGAT
49901 TTGAATGTTG TGATTTGTAG GTTGTACCAG TGAATTTTCT GCAGAAATCT
49951 TTGATGAGAA AATTAGAATA AAACTTATGA ACATTTAAAA ATCACCATAA
50001 GAAATACTGA TGTTTCTCTC CATTAAGTGA AGTACATATT AAAACAATAA
50051 TGAGTTACTG TTGCACACCT GATAGAATGA CTTTAAAAAA CTGGACAAAA
50101 CCAAGTCCTG GTTTGTACAG GAATGGGAAA ACCATACATT TCCCTATTGT
50151 GAATCTAAAA TTTCACAGCA GTCAGTTTTG GAATCCAGAT GGATAGTTTA
50201 TTTAAAAAAC AAACATTTTC TGTATAACCC ACTAATCTTA CTCCTTGTTA
50251 TTAACCCTGG AGAAATAAAA GCATAGGTTC ATATAAAAAA TCTGTATAGG
50301 AAAGCTTAGG GTGGCCTATG TATAATGTTC TTAACTGGAA ATAGCCCAGA
50351 TGTCCATCAA CTAGGGAATT CCATACAGTG GAATAGGTTT CAGCAACAAA
50401 AAGGAACAGT TGAAACATGC AGTGACATAG ATGGATCTCA AATGCATATG
50451 TGAAGTAAGG AAACCAGGCT CAAAAGGCTA CATGCTATAT GATTTCATTT
50501 ATTTGACACT CTGGAAAAGA CAAAGCTACA GGGAAAGAAA TCAGATTAGT
50551 GGTTACCAGA GGATGGGGTA GGAAAGGGAT TTCTTATAAA GGGCCACAAG
50601 AAATTTTGGG AGGGTAATGG ACGTATTCTC TAGCTTGATT GTAGCCATGG
50651 TTCCATGGAT GTAGGAGTTT GTCATGATTT ACAAAAATGT ACATTTAAAG
50701 AGGGTGGATT TGTTGTGAGT CAAACAAATT TTAATAAATC TAACTGATAA
50751 GACATGGGGA AACTTATAGA TTTAAAAAAA ACACTTAAAC AGGAATGCCA
50801 ACTAACTTAT TAGCATTTAT TTGAATCTCG GCTTCTTTTC AAATGAGACA
50851 ATAAAGAATA TTGAACACTG TCTGGATATG TCATTGCATT AAGGAATTTT
50901 TATATTAATG AATTAAGATA TTGTAAGTAT ATTAAAAGAG TATTTTGGAA
50951 ATACATGTTG AATTTTTATA CAGGTGAAAT GATAAGATTC CTGAAATTTA
```

FIGURE 3O

51001 CTTCAAATGA AATCTTATAG TGGGGAAGTA GGTAAAAATG TATACAAGAA
51051 ACAAGATTGG ACATTAATTG GTAATTATTG AACCTGAGTG ATGAGTATGT
51101 GAGGGTTCAT TGTACTGTTT TTTACTACTT CAAAAAGTAT TTGAAAATTT
51151 CTCACAATAA AAATTGATTA AAATTTATGA CTTAGTTTTA CAAATGTATG
51201 TTTAGTGAAT AGATTTTAAC AATACTAAAG GAATATTCTG CAATGAGTAA
51251 GTAGAGTTTA ACCCAGGAAT TTAAGGATAC TTTCATATCT GAAAAATGTA
51301 TCAATAAAAT TTATCACAGT GGTTCACCTA AGTAAAACCT CAGAATCTTT
51351 AGAGTAGACA CCAAACAGCA GGTGCCAAAT AACATACTCA CAATTGCATT
51401 TTAAAAAATT ATAGATGAGA AACCCCCAGC CAGGTGCCTT GGCTCACACC
51451 TGTAATCCCA GCACTTTGGG AGGTCAAGGT GGGAGGGTCA CTTGAGGCCA
51501 GGAGTTCAAG ACCTGTCTGC ATAGCATAGT AAGACCTTGT CTCTACAATA
51551 AATGAAAAAA TTAGCTGGGC ACAGTGGTGC GTGCCTGTAG TCCCAGCTAC
51601 TCAGAAGGCT GAGGCAGGGG GATCGCCTTG AGTCTAGGAG TTCAAAGCTT
51651 CAGTGAGTAT GATTGTGCCA GTGAACTCCA ACCTGGGCAA CAGAGCAAGA
51701 CCTGTCTCTT TAAAAAACAA ACAAAAAAAA AAAAAAAAAA AAAGGAAAAA
51751 GAAATCTCAC TTCCTTAACA AGATGAAAAA CCAAAATTAA TGATGTGGTA
51801 CCAAAGCATT GTTTCTCAGA GTGAGGTTCA TGGCCTACTG ACATCTGGAG
51851 GCCTAGGAGG TAGTAGTTAA AAATAAATAT CTGCTGAATC ATGAGCTGTC
51901 CACATTTACC TGCCAGAAAC GCTACAAAAA CCCTCCTTAG TTGATCTCCA
51951 TCTGTCTTTC CCAATCGTTT CTATCATCTA ACTTTCCCCA AGTAGTCTCC
52001 ACCCCTACAA CTGAGAACTG ATTTAGTCAT ATTTCAGTTA GTTTATAGAA
52051 AGTATTCTAA AATAAAAAAA AATCTTATCA TATCTGATTG AAACCCCCTC
52101 ATCCTAGACC AGTTCAAATT GGATCCCGTT TGTGAAGTTC TCCCAGAACT
52151 GCCAACCCAA CTTTAGCTTA ACTTAATTGC TAAGATGTTA ATATAATCTT
52201 CACTTTTATA ACTTAACAGA AAATGTTGTT ATGTGTTTAC ATGTCTGCTT
52251 TTTTGACAAG ATTATGAATT ACTTTTGGTC AGGAAAAGAG ATAGATGGTT
52301 TTTACGTTTG GTTTCGCATC TTATAGCCAT AAGTAAACTA CCTAGTGTAT
52351 ATAATAATAA TGTAGTCAGT GCTTTAAAGA TTATAAGATT TTTCAAAATG
52401 AGTTTTTTTA ATACTTGGCT GATAATATAT AAGGACATTT AATAGCACAA
52451 AAAGAGAATC AAGAAATCTG CTTTAATACA GGATTTTCTT CCTGAATGTG
52501 GTCTAAAAAT ACTGTAAATG AAAGTGGGGG AAAAGCAAAG GTAGTTATTT
52551 TATCAGTTTT AAACATCTGC TATTAAAAAG ACTTAATTCT GTTTAATAAT
52601 TTCATTTAGC ATTGTTTAAC AAAAATATAC ATACTTTAAT TTCTAAATAC
52651 TTTATGCATT TTATCATTAC TTAATACTAT TTTATATTAA TATTTAATAT
52701 GTAAATTTCT GAAGATAACT CATTAAACTT AATTCAGTGA ATAATAGTAA
52751 GTGTAATTGA CATTAATGAT TTTTATTATA ACTTTAATAA TTTAATATAT
52801 TTTTGCATTA GTTGAGAAAT TCATGGAATT TTTATTTTCT ATTTAATTCC
52851 AGTTGTGTTG CTTGATACAA CAACTGTACT GGGAGAGCTA GGATGGAAAA
52901 CATATCCATT AAATGGGGTA AGTTTAAATA TCTGAAAAAT TGCTGTCTTT
52951 TTTAGATTTT TAAGATCTCC TAATAGTTGA TGGAACAGTG AATTTTGGGC
53001 CCTACTTGTT ATGAATTTTG ACATATAACT TACATCCCAT AGAAAAGGTT
53051 AAAATACAAT TAGAACTGGT AATCAGTGGG AATGATATGT AAAGCTCCTT
53101 CCTCTCTCCT AAATTAGTAA TTATTCTTTA ATACTGTGTT TATACATAGT
53151 GACATTAGAA TATCTCCCAT ATAAATATTT TCCTTAAATA TAAATTTCTG
53201 TGTGTAAGTT TATATATGTT ACATTTATGT TAAATTTGAT AACCTCGATG
53251 AGTATTTGTG CATAAATAAA CTTTAAACTA CTGTAGTATA AATGGATTGT
53301 GCAAATATTA ACAATTTGGT TTTTAATACA GAATACAAGT CTACTAAAAT
53351 ATTATGCATT TTTGAACTTG GTGAAAATAT ACAAGGTGAT TAGGTTTTTG
53401 TTAACTGAAA TAGTTGTATT TAAAGGCTTG TTAAGGATGT GTAATTTGCA
53451 AAATATAGTT TTTCATGGAC CAACATTTTA GCTATGGTTG TACTTGACTT
53501 TTTATATATT TTTATATATT TTGCATCATT TTCATATTAC AATATATGTC
53551 TACTTCTCAT TTTCACACTG AGCTAAAATA AAAGGGTGGT TTCTAAAGCA
53601 TTTTGCTTTG ATTTTTGTCT AGTTAATCAA AATATTGAAT AATAGAGGCA
53651 GTCACATGTT TTCAGATACA CTTGGGTTAG CTTTCCTTTT TTTCCTTAGA
53701 AATGGTAATT TTCTTATTAA TCACATTCTT AGTTGACATT TTCACATTGC
53751 TTCTTCTATT ATATCTTTCA AATTTAAACC TCAAAGGAGA AATTGATCCA
53801 AAATATGTTT TATTCTTTTA GAATCTTTCA CATATTGCTG TTTGAATTTG
53851 ACATTTTACA ACAACAGTTA TTCACTAAGT GTGTATTTTC AACTAAAATA
53901 TCCTATGAAG AGTGAAATCT TCCTCTCTTT AACAGCCCAT TTGCTTCTTT
53951 AAATTTGTAA GTTTTATATA CTGCGAGTTT ATTTTTCTGA AATTTTTGTT
54001 TATTCTACTA GAGCTCTTAT CAAACTGTTT CTGAGGTATA TATCTTAAAC
54051 TAGGATTATG CTTTTATCTT CATTGTCTTA TTTCCATTAA AATGAATAAA
54101 CATTCGTATT GTTGAGTATA TTAAGTGGGT CATGTTTTTA CTTTTAAGAA
54151 ATGAATGAAA CTTTTCTAAA ATACCTTTTG TGTGTGTGCG TGTGTGTGTG
54201 TGTGTGAGAG AGAGAGAGAC AGAGTGTGTG TGTGTGTGTG TGTGTCTAAT
54251 CTTATGAACA GTAGAATGGA TAGGTGGTAT AAATAAGATT TTAAAAATAT
54301 GCAATTTATT TATTTTTTCT TTTTTAGTGA AGAGGATAGA TTACTGGTAC
54351 TAATGGAGCT TTACTTAATG CTATTTATAG GTTAAAATAA GGAACTATTC

FIGURE 3P

54401 AGTAAGGATG AAGAACTTGG GAAAGAGGCT ACTGAAAATG CCAAGAATGA
54451 AAATAATCTA GGTATCAATA TAGGTTACAG TACTTAAAAT CCACCAGAAC
54501 CATTAATCAG TTTATAACAT GTAAACCAGC ATTTATATCG AAACATTAAA
54551 ATTGTAATTA TATCCAGTTG AAATCATATA AATTTTTCAG GTACTCAGTT
54601 TCACTGAGGC ATGCTCATTT GATTGACCAT TTTAACAATT ACACTTTTAC
54651 ATAGACACTA ATTCAATTGA TTTTACAAAT ATGTCATGGG TGGAAGAGAC
54701 ATGTAGACAA TATAATTGGC AATATATGAG GTAAAGTATG TTTGGTATTA
54751 TAAATAATGT ATTTCTCAGG AATAACTTTT TAATTGAAAA AAACTCTTCC
54801 TATAAAGAAT TGACATTTTT GAAATTGTAT AATGTGCTAC ATAAAATATA
54851 GGTAATTTAA TCATTGATTC CATAGATTTT TCTTTTTACT TAAATTCATC
54901 ATTCCACTAG TAATATCATG CTGATATAGT TACAGAATTA GGCATTCAGA
54951 GTGTGCCTGT GAACAGACTG ATAAATAGTC ATTTCAGTGG AAAATTGAGC
55001 ATCTCTGGTG GTTAGTAATT ATGGAAAAAG GATGAATAGT CTGAACAAAT
55051 AACGTTTTAG GCTTACAGAA ATGAAAAGAG AATTATGAAT TTTCTAAAAC
55101 ACTTGCTTAT CAATTCATTT GTGCCAACAT TTAAAATATA CTTTTTCTTT
55151 TAAGCATTGT CCTGAATTCA ATTTAACAAA CTTCTGTTTT ATGCTGCTCT
55201 ATGCCAAATA CCCTGTTATT GTGCCTAAGA CAGATTTTTC TACCCTCAAG
55251 GGGTATTGAA GCACAGCGAT AATTATACAG AATCACTAGG CCAAAGAATG
55301 TGTCTTCAGG TTGTTCTGAG TAATGTTTTG TGAAAGAATA ATAAAAGGAG
55351 AGGTTAATTC TGGTCAAGGA AAATTGGGAA TAAGAAGTTG CATGTCAGCT
55401 CTTTCAAAAA AAAAAAAAAC GTGAAGGAAT TGGCCTTGAA AAAAAAGGGA
55451 GAAGGCAACT TCTAGGCGAA AGGAGTGGCT TGAGCAAAGG CACAGAATTA
55501 TTTCATGTAT GTATCAGGTT TTAGGAATGC TGAGAATCAT TTGGCCTGTA
55551 GGGTTGCAGT GGAAATAATC ATTTGGCTGG AGTGGAGGTA TACAGTGAGA
55601 AATAGGACCT GTAATCATAG GCTAAACCAC ATTTTGCAAG ACTTAGAATT
55651 TCACTAAGTT GAGGTAGATA GTGCATATCT CTGCATCAGT AAGTTAACTT
55701 TTAAAACCTA TGTTTAATGT GTACATAGTG GATGAGATCT TTGTTACATA
55751 GTTGTATTGG ACTTAGATAT AGCCACTATA GTATATAAAA TCAGATATCA
55801 TTTTCAACAG TGGAGTACCT GTTAATTAAA CATTAAGACA AAATTGATGT
55851 TAGGAAAACA AAAGTGCTGT TGGATGTTAC ATCACATTTT ATTTTAATGG
55901 CAATTGGAGA TTAGAAATCT TTGTGTTTCT CTAATACTGA ATATTGGTTT
55951 TGAATATCAT ATTTTATAGA TAATTTTTGT GTGCTCTGAC TTAGATGATC
56001 ACTAGGGCTT CAGCAATGCA ATATAGTACA AGATATGTGA TCTTATCTGT
56051 TGGACATAGT GAATTGGTAT TAGGAAACTT ACCCTGAAAT ACTTCATGTA
56101 TTGGTCATGG TTCTTTAGAG AAAAAGAACT AATAGGAAAT ATATCTGTAT
56151 CTGTTACACA TATCTATATC TGTTTTTCTA CCTAATGAGA GAGAGATTTA
56201 GATTTATTTT GGGAATTGGC TCACATGATT ATGGAGGACA TGAAATCCCA
56251 TGATCTACAA ACTGAAGAAC GAGGAAAGTT GGTGGTGTAA TTTAGTCCTA
56301 GTCCAAAGGC CCGGGGAGTG GGTACTGACA TCAGTTCCCA AGTCTGAAGA
56351 CCCAAGAACG AGGAGCTCTG ATTTCTAAAG GCGGGAGAAG ACAGATGTCG
56401 CAGCTTAAGA AGAAGGAGCA AATTTGTCCT TTCTACATCT TTCTCATTCT
56451 ATCTCCACTT CAGTGGATTG GATGAGGTCA AGTTACATTA GTGAGGAAGG
56501 GCAGATATTC TTTAATTTAT CTATTGATTC AAATACTAAG CTCTTCCAGA
56551 AACATCCTTA CACACACACC TGGAAATAAT GTTTTAGCAG TTATCTGGAA
56601 ATAATGTTTT AGCAGTTATC TTTAGCCTAG TCATGTTGAT ACATAAAATT
56651 AACCATCACA GTTAGGAAAA TAAACATGTC ATTCATGTGT AAATAAAAGC
56701 TGTAAGTAAA CCTAACAACT AATGATTTTT ATTTTTATAA TAAAAGAAGC
56751 AGAGATTACA ATCAACCTCT GTAGAAAGAT ACTTTATTCC ATTAATCGGA
56801 GCCCATCATT TCCTAATATA ATTTTTCCAA AGGTGAAAAT CAAAGGTTGG
56851 ATGTACTATG ATAGAGAATG GAGTAACTAC CAATAAACAT TTGTTTTTAT
56901 AATGCAATTT ATATATTTCA TATAGTAAGA AGTAATTCAT CATAGTAGAA
56951 GATTTCAGTA TTACATTTTG ATTCATCCTA AAATTGAAAT TATCCAAAAC
57001 TATACCATGT GCATATTCAA GTTCTGAAAA TGTAAATTTT GGTGATAATT
57051 TCTGTTGGTG AATATGGATT GCTATAGTTA CTGTTTTCAA ACTGATATTT
57101 AAATATTTTT TCTTCTTAGA AACTTCACAA CATATATGGT AATGTTCTAA
57151 ACACCCGTCA TGTTAATTTC AATTATATTG TTCCATATTT CAAAGAAATG
57201 CATTAGGTTT TGTTAATTAA TCAATTCTAT CAGTGTACAT TTCTTTAATA
57251 TCCATGTTTG TAAGACATTT TATAGCTGTG AGGTGTTAAT TGCCATCCAC
57301 ATAAGGGAAA GGACTTGATA ATAGTACTCA TATCATTAGA TTATTAGAAG
57351 GATGAAATTA TGTAATATAT GTAAAGAAGT TAAAACAATG TCTGGTTCAT
57401 AATAAACATT ACATAAATAT TATCATTAGG AGTAGTGCAA GAACCCCAAA
57451 TATTTTAAAG AAATGAAAAA TCCAGACTTC TATATAGACC ATTTGTTTCT
57501 TTGCTTTTTC CAGAATCATG TTTTATCATG TATCAAATAT TTTTTTTTCT
57551 GAACCACAAT TATATTTTTG TGCCTTTGTT TACTTAACTA ATAAGGCAAA
57601 AATGTAGAAT GAGTACTTTT TTCATTTAAA TATAAATAAA ATATACATGT
57651 ACACTCATTT ATTTAATCTT TCACCGCACA TTATGTGAAA AATGCTATTT
57701 TGTGTACTGG AAGTGGTGGT GGACATGGTC AGTCATTACA AAAATATATG
57751 AACCCTCTTA GGATCTAGTA CTAGTTATGA TCTTTAGCTG TGAATACTAT

FIGURE 3Q

57801 ATCCAGGTTT GCTTGATATA TAATCAAAAC ATATGTTATA TTTTATTAAG
57851 TTAGCTTCAT AACCAAGAAT TGCCAAAGCA AATATGGGCA GTAATAATAG
57901 AAAGACTCAT TGACCCTAGA TGTGAGATTT CAGTGTGGTA ACGGCCTCTT
57951 AAAAGATGCT GAATCGAATT AACCAGGAGA TAGAATTTGA AGGCCAGTGT
58001 GTTAAGTTCC TTGAAAGCAT TTCCCTAGAA AAGAAAAGTA AACCTGGATA
58051 CTCACTTGGA AGCGATAGAT AAGCGAGACA TAATTCTTAC ATTTCTTCAT
58101 TTGGTTTGAT GAGTCAAATA TTTTAAAAGA TCAGCCTGCA AATGAACAGC
58151 CTCCTGCACA AAATCTTATG TGATAGCTGA GCATATTTGA AGATGGTCAT
58201 GTTAAGTACC CAAACTTTCT CTTATAATCA TTTGCAGTAG GAGGAACACA
58251 ATCTGCAAAG CCAGCGTTTG TTTCTTGAGA CCATTCCTTT CAGGGGCTTG
58301 TCCCTGTTGA AGCACATGTC AGCACAGGTG AGCTCATGAT TGCCTGGAGA
58351 TCTCCTTGTG GCTCCTGTGA CAAGCAGAAA GGAACACATT GTAGGATAGA
58401 AGCCTCCTGT GTTTATGGAG GGTGGCTTCC AAAGTTGCTG TCTCCTCTCC
58451 TCTTCCTTGC TTTATGTAGA TTTAAATTTC TGACCTATTT CATTTTTCTT
58501 CTCTCCAAAG AATGTTTTTT AACATTTCTT GTTCTTGCAA GGTAAGTCTG
58551 CTGGCAACAC ATTCTCTGAA TTTTGTTTGA GAAAGTCTTT ATATCTTCTT
58601 CACTTTTCAG GGAAAATTTT ACAAAGTACA GAATTCCAGG TTGGTGGGCT
58651 TTAACAAATC TCTAAATACT TTAAATATTT CACTCCACTG TTATTGCTTG
58701 CATGGTTTCT GAGGATGAAT TGTATGTAAT TCTTATCCTT GCTCCTCTAT
58751 TCTTAAGGTG TTTGAGTCTT CTGGATTCTT TCAAGGTTCT TTATATTTGC
58801 TTTTTTTTTA AATTTGATGT GAAAATATTT TTTGAAGTTT GAATACAGTA
58851 TATGTAGGTA TAGTTTTTCT GGCATTTATC CTGCCTAGTG TTCTTTGAGC
58901 TTCCCGAATC TGTGGTTTGG AGCCTGACAA TAATTTGGAG CAATGTCTGT
58951 GTCATTATTG CTTTAAATAT TGCTCTCTTC CTTTCTCTTT TTTTCCCCAT
59001 TTGATATTCC CATTACACAT AAACTGTTGG GTTTCTGCTT CCTTAAATTA
59051 TGATTCTCAG GCCGAGGTGG GTGGATCACC TGAGGTCAGG AGTTCGAGAC
59101 CAACCTGGCC AACATGGTGA AACCCCGTCT TCACTCAAAA TACAAAAATT
59151 AGCTGGGCAT GGTGGGTACC TGTAATCCTA GCTACTCAGG AGGCTGAGGC
59201 TGGAGAATCA CTTGAATTGG GAGGTGGAGG TTGCAGTGAG CCAAGATCAT
59251 GCCCCTGCAG TTCAGCCTGG AAGACAGAGA AAGATTTCAT CTCAGAAAAA
59301 AAAAAAAAGT TATGATTCTG TGTATCCACC AGTCCATCTC TCCAATTCTG
59351 GGGCAGTGCT TTACCCGCTG ATCTAAGTGG AGTTGTTCAT TTTTCAGTTT
59401 GTTCAGCTTT TTACTTGTTA CAATGGAGAA GCTANNNNNN NNNNNNNNNN
59451 NNNNNNNNNN NNNNNNNNNN NNNNNNNNNN NNNNNNNNNN NNNNNNNNNN
59501 NNNNNNNNNN NNNNNNNNNN NNNNNNNNNN NNNNNNNNNN NNNNNNNNNN
59551 NNNNNNNNNN NNNNNNNNNN NNNNNNNNNN NNNNNNNNNN NNNNNNNNNN
59601 NNNNNNNNNN NNNNNNNNNN NNNNNNNNNN NNNNNNNNNN NNNNNNNNNN
59651 NNNNNNNNNN NNNNNNNNNN NNNNNNNNNN NNNNNNNNNN NNNNNNNNNN
59701 NNNNNNNNNN NNNNNNNNNN NNNNNNNNNN NNNNNNNNNN NNNNNNNNNN
59751 NNNNNNNNNN NNNNNNNNNN NNNNNNNNNN NNNNNNNNNN NNNNNNNNNN
59801 NNNNNNNNNN NNNNNNNNNN NNNNNNNNNN NNNNNNNNNN NNNNNNNNNN
59851 NNNNNNNNNN NNNNNNNNNN NNNNNNNNNN NNNNNNNNNN NNNNNNNNNN
59901 NNNNNNNNNN NNNNNNNNNN NNNNNNNNNN NNNNNNNNNN NNNNNNNNNN
59951 NNNNNNNNNN NNNNNNNNNN NNNNNNNNNN NNNNNNNNNN NNNNNNNNNN
60001 NNNNNNNNNN NNNNNNNNNN NNNNNNNNNN NNNNNNNNNN NNNNNNNNNN
60051 NNNNNNNNNN NNNNNNNNNN NNNNNNNNNN NNNNNNNNNN NNNNNNNNNN
60101 NNNNNNNNNN NNNNNNNNNN NNNNNNNNNN NNNNNNNNNN NNNNNNNNNN
60151 NNNNNNNNNN NNNNNNNNNN NNNNNNNNNN NNNNNNNNNN NNNNNNNNNN
60201 NNNNNNNNNN NNNNNNNNNN NNNNNNNNNN NNNNNNNNNN NNNNNNNNNN
60251 NNNNNNNNNN NNNNNNNNNN NNNNNNNNNN NNNNNNNNNN NNNNNNNNNN
60301 NNNNNNNNNN NNNNNNNNNN NNNNNNNNNN NNNNNNNNNN NNNNNNNNNN
60351 NNNNNNNNNN NNNNNNNNNN NNNNNNNNNN NNNNNNNNNN NNNNNNNNNN
60401 NNNNNNNNNN NNNNNNNNNN NNNNNNNNNN NNNNNNNNNN NNNNNNNNNN
60451 NNNNNNNNNN NNNNNNNNNN NNNNNNNNNN NNNNNNNNNN NNNNNNNNNN
60501 NNNNNNNNNN NNNNNNNNNN NNNNNNNNNN NNNNNNNNNN NNNNNNNNNN
60551 NNNNNNNNNN NNNNNNNNNN NNNNNNNNNN NNNNNNNNNN NNNNNNNNNN
60601 NNNNNNNNNN NNNNNNNNNN NNNNNNNNNN NNNNNNNNNN NNNNNNNNNN
60651 NNNNNNNNNN NNNNNNNNNN NNNNNNNNNN NNNNNNNNNN NNNNNNNNNN
60701 NNNNNNNNNN NNNNNNNNNN NNNNNNNNNN NNNNNNNNNN NNNNNNNNNN
60751 NNNNNNNNNN NNNNNNNNNN NNNNNNNNNN NNNNNNNNNN NNNNNNNNNN
60801 NNNNNNNNNN NNNNNNNNNN NNNNNNNNNN NNNNNNNNNN NNNNNCCTCT
60851 TTTAGGAATT TAGGATTTCT ATGTTAAGAG TTCAGGCAGA AATAGCAGCC
60901 AGAAACATCT GCCGTAAAGA CACATTGAAA GTATACATGC AGAAGGGTTA
60951 GAGTAGGGGG ACTTGATGAC CTGAAGTCAT GTGCAAGTAA CAGTTCTAGG
61001 AGAGCAGGGA AAAAAATCCA ATAACTAAAG GGAGGCCATT CAGTAGTAGG
61051 AGGAGAACAT AGAAGATGCA GAGGAAAAGC CATGAAGAAA GGAAAGATTA
61101 AGGTAGTTAG CACCTGTAGA GATGACCAAG TTTCTGCTGA ATCTTCAGGT
61151 CCAATTCTTA GTTTTTCTTA AATTCCTTTT ATCTGGGCTG CCAGATTGTA

FIGURE 3R

61201 AATACAGATT GTACTTATAA TAATAATAAT AATAACAGTG AAACACCAGC
61251 ACCATTTTGA GACAGAACAG GAAACATGAA AGATCGTGGA AGGTAGAATT
61301 TCCTTGAGGA GAACTCAGGC ACATGAATCA TCCAAAGCTG ATGGCTTTCT
61351 TTTATCAGCT CATGCATGGG TAAATGACCT CCCCTACATC CAGGTAGTGC
61401 AGAGAAACAG GTGAAGGAAT ATGCATAGTT TATTATAGAG TCCCTAAATT
61451 TTTAAATATT TAATACTCGA GCAACTATGA TTTGTGTCAC TTCTTTCTCC
61501 ACTATCTCAG AATATTCCTT CCTGTACAGC AACCTCTGCA AAAGAAAATG
61551 TATTGCTGCC TCATTTTTCA CTAGTTGAAA GAGCATGTTT TGTAGAATGA
61601 TGAAATTCTA TGGTGAGGAA GAAAAGTAAC AGAAAAGCAG GTAACAATGA
61651 TTTAATAAAT CAGATGTGAA GTATTTATTG ATGTTCCTGA ATATGTAATC
61701 ACCCTTGTAT TCTCTGGGCA GCTGAAAAAT AAGTATGTAT GGAATTCATT
61751 TTTCAGTATC CCCACTGTTC TTTAATGAAT AGCCATGATG ATGTCTTTCT
61801 GTAAAAATAT GTAGATGTAT AATACACATT ACACACACAC ACATACACAA
61851 ACACACACAT CTTTAAAAGG TATGGGTCTC ATTAAGTCAA ATCTTCTTGA
61901 CTTACATAAA ACAGTCTTTT ATTTATTTTT ATTTTTATTC ATTTTATCTT
61951 TATTTTTTTC ATTGTTACTT ACAAACCTTT AACTTCAGTC TTTACTTCCA
62001 AGAGAAGTTT CTGGTTATTT CTTTTAAAAT AAATTCCTAT ATTGTAAAAT
62051 ATAAACTAAG ATTCTGATTT TATCAGCAAG TTCTAATTGT TTTACTTAGA
62101 GTCATTAAAA TATTTATAAA CTATTTTATT TATAAATAAA ATAATCTGTA
62151 TCTAAATCCA GAGCAAGCAC ATACAAATGC TAAATTATCT TAGGAAACCC
62201 TAACATATTA TTAATAAAAT ACATATATTT TTTTTTTTTT TGTAGAGATG
62251 GGGAGGTCTT GCTATGTTGT GCAGACTGGT CTCAAACTCC TGGGCTCAAG
62301 TGATCCTCCA TGAGCCACCA TGCCTGGCCT AGACATTTTT ATAAATTTAA
62351 TTATTTTCTA TTTTAAGTGA TAAATTTACT CTTATTTTCT ACAGACAACT
62401 ACCAAATCCT ATTGATTCAA CCTTCAAAAG CTCTTTCAAA TCAGCCTATA
62451 TCATCAGCTT CATCTGTCAC TCCATCATCA GTTTGACTCT TCATCATTTC
62501 CTCTCCAAGT TACCATAGTT GCATCCTAGA TTGTTTACCT GCTTTGGGTC
62551 TTTCTCCAGC CCCTTCTTCT GACCTTTCCA ACCCATCCCT CATCCTGTTG
62601 CCAGAACTGA TTTTCTAAGC TGAAGATCAA TTTATGTCCA TGTCACTACT
62651 CTACTAAACC CCTCCTCTCC TTTCCTACCG TTTAACCTGT GGCCAACAGC
62701 TGCCTCTTCT GATCTTCATC TTTAACATTC CCTGATCTTC AGCCACCTCC
62751 ACTTTCCAGC TTTTTCAAAA AAGACCTTTT TGGTAGTTTC TTCCATATGA
62801 CTTGCTTTCT CTTGTCTCTG GATATAGGAC CATGCTTATG TCTATCTGGA
62851 ATGTTCCCTT TTATCTCTCT TCACTCCAAC CCCCACTTTC TCTATCTCAC
62901 TTTTTCCTAT TGGTCTCTTA AGACAGAAAT TTTCTGCCTT TTCTGGAAGA
62951 CTTATATTGC CAAAGGTTGA ATTAGGAAAC TCCTTTTCTG GGACCACCTG
63001 AAACTCAGTG CATATCATAG CATTTATCTC ACAATACTTA AATGTCTATC
63051 TTTTACCAGA TTGTAAACTC TTGCAGTAAT GGATTGGGTG TTGTGTCTCT
63101 GGGTCAGGTA GATGGCATAG TAAGTGCTAT ATGAGGGATG CTCAATAAAA
63151 GTTGGCTGGA TAGCTAAGTA GATGTACATG TAACAAATTA TTTTAAATAA
63201 GATATTGTTT AAAGGCTATA TTTTGCAACT CTCATTGGAG CTGGAATAAT
63251 TTGATACTAA CTTTGGGCAG AATCAGTTGT GGAAAAAAGA CTAAATGGTT
63301 GTGAAAATTG AACTGTGTTC TTGTTCATCG TTAGTCTTAA GTACAGGTAG
63351 AAAGTGTATA CATTTGCTCT CATTTTTTGT ATTTTAGACA ATCCATTTTC
63401 TCACTATTCT CTCACTAAAA TAGAAGTTTA AAGGTGGAAT GGAAAGATAT
63451 TGACCTACAA AATAAAAAGA CTACAAAATA GCCTATAAGC CATTTAAGTA
63501 ATACCTATCA AGACTTAATA ATATACTTTC AAAGAATTAA TGACCGGTTT
63551 AGAACAGTTG ATGATCTGAA TCACATCTGG GAATTATTCA CCCCAGGTGG
63601 TTATTAATCC TGCACCCTTG TAATTAAGAT GAGAATAAAA AATAGAACAT
63651 ATGGATTTTT AATGAGTGAT AGATGGACCG CAAATTTTAG AGAATTAATA
63701 CTAACCAGTG AAACTTTCAA AAAACACAGG TTGGCGTTAA ATGTTAAATA
63751 GGTTTTTGTA ATCTGTATCC ATGCCATTAG TATTTTGAAT TAATGTACCA
63801 TAGTCAGCAA AATCGATTCT TAAAATGAAT TGACTTGGTT TTATTTTAGC
63851 AAAGCAAAAC CTGTTGTGCT AATAAATATA ATGCTTAACT TAGTCTTCTT
63901 CTTCCCCATA ATTAGCAATG TATATGCAAA TACTTCAATG AAATTAAAGA
63951 AGTCTTTCAT CAAAAGCATG GAGTTAGGAT TTGCGTGTGT ATATAGTATG
64001 TGTGTGTGTA TATATATATA TATATATTTT TTTTTTCCTT TGGATGTTCA
64051 TGCATCCTAA AGGCCATGTT TGGGAGGATA AAATGAAATT TGTCCTCTTA
64101 ATTTAGAGAG TTTGATTTAA TAATGTGATT AATTAAACAA ATTATAGGCT
64151 TACCTTAAAT GCAATGCTTT CTGGTGCACA TTAGAAGGAA TTTTATTTAT
64201 GGTTACCAGT GAAAATAAGA AATTCTCATA TTCATTATAA ATATCATAGT
64251 AAATAAAATAT GTACAGCCAC CATATTATAG TTAATTTGTA TTCTTTCTGT
64301 TGATAAGCAT TATACTAATC GTTTGGATGA CCATAAGCCC TAGTGGGAAC
64351 AGAATTGGCA AGGCACATTA GAAGACATGA ATGGAGGCCC ATATGCCTGG
64401 AAAATAGAGA GAGAGAGGGG GAGACAGAAA GATTGAGAGA GAGAGAAAGA
64451 GAGAGCAAGC AAGAGAAGGA AAGAGAGGTG TCAAGGAAAA ACAGATAAAA
64501 GGGCCTTGTA AGTGATGCTA AGGCATGCCA TTATTATCCT AATTTCAGTG
64551 TAATTTATTA GAGAGTAGTA AGCAAATTAA CATTTTGAAA AGATTACTGT

FIGURE 3S

64601 AATTGAATGC AGATAGAATA GTTAGAAAAA TTCAACCCAA GCACAAGGAA
64651 CTTAATAGTC TAGATGCAGA CTATTAAGTT GAATATTTGA ATGTAATATT
64701 GTACATTTGA CAACAAAAGC TATTATGAGC TAATGTCATT AAATATTATC
64751 ACATAGCCCC CAGCTATGTT ATGTCTATCT AGATATACAA TCTGTATCAT
64801 TCCAACAAGG CCGTCTTCCT TACAAATTAC TATTTATATG ATGGTTTTGA
64851 ATAGGTTTTT AAGATTTGAA ATCTCTAAGC CTCCAATTTT AATTCTTTTG
64901 TCATAGAGAA GGAATAAAAG TTGAATGGTG AAAAACATAT AAAGTGAATA
64951 TTCACAAATA TTGTCTATAC TTTTACTGAT TTATCCTCAA TATTTAACAT
65001 TAGTTGATAG CACTAAGTTT GCCATCAATA AATATCACTT AAGTGAAAAC
65051 TGAATAAATT GATTATTATT TTGAGTATTA GAATTATTGT AGAAAGATAT
65101 ATTTCACGCA ATATACAGAA CACTTAATAT GGTGTCCACA TTCTGCCTAA
65151 TTTAATTGAA ATATTGTCTA TTATTAGGTT TAAGACTTTG TAGGATTATG
65201 TTTTCATTAT TTCACTGAAA ATCTGAAAAG AAGATAAAAC ACTTCAGAGG
65251 GAAACTATGA ATGTTACTGT ATTTCTTTAT TTCACTAAAG ATCCATTTCT
65301 AGCATTTTGC CTTTGTTTAT AAACGTAATT TGGATAACAT TTATGAACAT
65351 AATGCTGGAT ACAAGATCAA TATATGAATT CAAATTTATT TCTATCTACC
65401 ATAAACAAAC AAAAAATAAA AATGTATAAC ATATCATTTT CAACACATCA
65451 AAAACACACA CTTTTACTGC ATGAACTCAT GTGCAGAGTC TAGAGAATTT
65501 GATCTCATAG AATTAGTGAG TAGAATAGCA GTTAGTGGGG GATAGGGAAG
65551 GTACAGGGGA GGGAAAAAGA GACATTGGTC AATGTGGACA AAGTTAGAGT
65601 TAGGAGGAAA GAGTTTTGGT GTCCTATTAC ACAGTGGAGT GACTATGGTT
65651 ACAATAATAT TGCATATTTC AAAAGAACTA GAATTGCTTT TGGCAGTATG
65701 ATTATTTTTA TGATACTGGT TCTTCCCATC CATGAGCATG GAATGATTTC
65751 CGTTTGTGTC ATCTGTGATT TCTTTCATCA GCATTTCGTA GTTCTTCTCG
65801 TAGAGGTCTT TCACCTCCTT TGTTAAGTAT ATTCCTAGGA ATTTTGTTTC
65851 ATTGTTGTAG CTATTATAAA AGGGATTGGG TTCTTGATTT GATTCTCAGC
65901 TTGGTCATTG TTGGTGCATA GAGTGCTACC AATTTGTGTA CTCGATTTTG
65951 TAACCTGAGA CTTTACTGAA TTCATTTATC AAATACAAGA GTCTTTTGGA
66001 GGAGTCTTTA GGGTTTTCTA GGTATAAGAT GATATCATCA GAAGCGAGGA
66051 GGATAGGAGG GGGCAGTGAA GGATGAAAAA CTACCTATTG GGTACAATGT
66101 ACGCTATTTG GGTGACCTCT ACACTAAAAG CCCAGACTTC ACCACTATAC
66151 AGTTCATCCA TGTAACCAAT AACCACCTAT ACTCCGAAAG CTATTATAAT
66201 AAAAAATTTA AAAAAATAAC TATAAGAGAG AATTTTGAAT GTTCTCACCT
66251 CAAAGAAAAG ATAAATGTTT GAAGTATTGG ATTTGCTAAA TACCTTGATT
66301 TGATTATTAC ATAATGTATA CATGTATCAA AACATCACAC TGTACCCCAC
66351 AAATAATGTA TAATTATGTG TCAATTTAAA ACAAAATAAA GTTAATTAAA
66401 AAACCCACAA ATACTTAAAG TATCACAAAT CTAAGAAAAG ATGTGCGAGA
66451 ACATTGCATT GAAAACTACA AATAACCTTT GAAGAAAATA AAGACATATA
66501 GAAATTGAAA GATATACCTG TTCATGTATT GGAAGAATCA GTTTAAAATA
66551 CAAGTCAAAT TTCTCAGTAC CCTGTAAATG TAATGAAAGG AAACACCTCA
66601 GCTAATATTT TCCCCCCTTT TAAAAAAAAT TGAGTTGAAA TGAACATATC
66651 ACAAAATTGA CCATTTTAAA GTGAACAACT CAGTATCATT TAGCACATTC
66701 ACAATATTGT ACAACCACTG CCTCTATTTA GAGTGAAAAT ATTTCATCAC
66751 CCCATATCCA TTAATCTGTT GCACCCCATT CTTCCTCCCC CCACCTCACG
66801 CGCTGGCAAA CACTAATCTG TTTTTTATCT CTGTGGATTC ACCTATTCTG
66851 TGTATTTCAT ATAAATTGAA TCGAACAATA TATGACCTTT TTGTGTCTGG
66901 CTTCTTTTAC TTAGCGTGGT TTTGTTTCAT TTGCATTGTA TAATGTGTCA
66951 GTACTTCCTT TTTATAGTTG AATAATATTA CATTGTATGT ATATATCAGT
67001 TCGTTTATCC ATTTATATAT TAATGAACAT TTGGGCTTTG TGCACATTTT
67051 GGTTACTGTT AATTGTATTG CTGTGAACAT GTGTGTACAT TATTTGAGTT
67101 CCTGCTTTCA GTTATTTTGG ATATATACTT AGGAGAGGAA TTTCTGGGTC
67151 ATATCCCAAT TCTGTGTTTA GCTTTACATG GAACCACCAA ACTGTTTTCC
67201 ATAGTGGCTG AACTATTTTT GTGTTCTCAT CAGCAATGTG TGAGGGTTCC
67251 AGTTCCTCCC TATCCTCACC AATGCTTGTT ATTTTCCCTT TGGTTATTCT
67301 TTTTTTAATG TATGTAGAAA TTGATAAATC ATTGTATTAG TCTGCTTTCA
67351 CACTGCTGTT AAAGACATAC CCAAGACTAG GAAGAAAAAT AGGTTTATTG
67401 TAGTCAAAGT TCCACTTGGC TGGGGAAGCC TCACATTCAT GGTGGAAGAT
67451 GAAAGGCTCT TCTTACATGG TGGTGGCAAC AGAGAATGAG AGAGAAGCCA
67501 AAGCAGAAAC CACTTAAAAA ACTATCAGGT CTCCTGAGAC TTATTCACTA
67551 CCATGAGAAC CGTATGGGGG AAACTGACTC CGTGATTCAG TTATCTCCCA
67601 CAAGGTCCCT CCCACAACAG GTGGGAATTA TTGTGAGTAC AATTCAGTGA
67651 GATTTGGGTT GGGACAAAGA GCCAAACCAT ATTATTCTGC CCCTGGCCCC
67701 TGTCAAATCT CATGTCTTCA CACTTCAAAA CCAATCATGC CTTCCCAAAA
67751 GTCTTCCAGA GTCTTAACTC ATTTCAGCAT TAACTCAAAA GTGCAGAGTC
67801 CAAAGTCTCA TCCAAGACAA GGCAAATTTC TGCCTATGTG CCTGTAAAAT
67851 AAAAAACAAG TTAATTACTT CCTGGGTACA GGCATTGGGT AAATACAGGC
67901 ATTCCAAATG GGAGAAATTG GCCAAAACAA AGGGGCTACG NNNNNNNNNN
67951 NNNNNNNNNN NNNNNNNNNN NNNNNNNNNN NNNNNNNNNN NNNNNNNNNN

FIGURE 3T

68001 NNNNNNNNNN NNNNNNNNNN NNNNNNNNNN NNNNNNNNNN NNNNNNNNNN
68051 NNNNNNNNNN NNNNNNNNNN NNNNNNNNNN NNNNNNNNNN NNNNNNNNNN
68101 NNNNNNNNNN NNNNNNNNNN NNNNNNNNNN NNNNNNNNNN NNNNNNNNNN
68151 NNNNNNNNNN NNNNNNNNNN NNNNNNNNNN NNNNNNNNNN NNNNNNNNNN
68201 NNNNNNNNNN NNNNNNNNNN NNNNNNNNNN NNNNNNNNNN NNNNNNNNNN
68251 NNNNNNNNNN NNNNNNNNNN NNNNNNNNNN NNNNNNNNNN NNNNNNNNNN
68301 NNNNNNNNNN NNNNNNNNNN NNNNNNNNNN NNCAGAGGTT CTCCATGAGA
68351 GCCCTGCCCC TGCAGCAAAC TTCTGCCTGG ACATCCAAGG TGTTTCCATA
68401 CATCTTCTGA AATCTAGGCA GAGGTTCCTA AGTCCTAATT CTGTTTTTTA
68451 TTTTATTTTT CCGTAAGTTA TTGGGGTACA GGTGGTATTT GGTTACATGC
68501 ATGAGTAAGT TCTTTAGTGG TGATTTGTGA GATTTTGGTG CACCTATCAC
68551 CTGAGCAGTA TACACTACAC CATATTTGTA GTCTTTTATC CCTTTCCCAC
68601 CTCTCACCAC TCCCACCATT CCCCCCAAGT CCCCAAAATC CATTGTGTCA
68651 TTCTTATGCC TTTGTGTCCT CATAGCTTTG CTCCCATGTA TCAGTGAGAA
68701 CATACGATGT TTGGTTTCCC ATTCCTGCAT TACTTCACTT AGAATAATAG
68751 TCTCCAGTCT CATCCAGGTC ACTGATAATG CTGTTAATTC ATTCCTTTTT
68801 AAGGATTCGT AGTATTCCAT TGTGTGTCTG TGTGTGTGTG TGTGTGTGTG
68851 TGTGTGTGTG TGTGTGTATA GTCAATCATC AATCTATGTG ATATATATCT
68901 CACAGTTTCT TTATCCACTC ATTGATTGAN NNNNNNNNNN NNNNNNNNNN
68951 NNNNNNNNNN NNNNNNNNNN NNNNNNNNNN NNNNNNNNNN NNNNNNNNNN
69001 NNNNNNNNNN NNNNNNNNNN NNNNNNNNNN NNNNNNNNNN NNNNNNNNNN
69051 NNNNNNNNNN NNNNNNNNNN NNNNNNNNNN NNNNNNNNNN NNNNNNNNNN
69101 NNNNNNNNNN NNNNNNNNNN NNNNNNNNNN NNNNNNNNNN NNNNNNNNNN
69151 NNNNNNNNNN NNNNNNNNNN NNNNNNNNNN NNNNNNNNNN NNNNNNNNNN
69201 NNNNNNNNNN NNNNNNNNNN NNNNNNNNNN NNNNNNNNNN NNNNNNNNNN
69251 NNNNNNNNNN NNNNNNNNNN NNNNNNNNNN NNNNNNNNNN NNNNNNNNNN
69301 NNNNNNNNNN NNNNNNNNNN NNNNNNNNNN NNNNNNNNNN NNNNNNNNNN
69351 NNNNNNNNNN NNNNNNNNNN NNNNNNNNNN NNNNNNNNNN NNNNNNNNNN
69401 NNNNNNNNNN NNNNNNNNNN NNNNNNNNNN NNNNNNNNNN NNNNNNNNNN
69451 NNNNNNNNNN NNNNNNNNNN NNNNNNNNNN NNNNNNNNNN NNNNNNNNNN
69501 NNNNNNNNNN NNNNNNNNNN NNNNNNNNNN NNNNNNNNNN NNNNNNNNNN
69551 NNNNNNNNNN NNNNNNNNNN NNNNNNNNNN NNNNNNNNNN NNNNNNNNNN
69601 NNNNNNNNNN NNNNNNNNNN NNNNNNNNNN NNNNNNNNNN NNNNNNNNNN
69651 NNNNNNNNNN NNNNNNNNNN NNNNNNNNNN NNNNNNNNNN NNNNNNNNNN
69701 NNNNNNNNNN NNNNNNNNNN NNNNNNNNNN NNNNNNNNNN NNNNNNNNNN
69751 NNNNNNNNNN NNNNNNNNNN NNNNNNNNNN NNNNNNNNNN NNNNNNNNNN
69801 NNNNNNNNNN NNNNNNNNNN NNNNNNNNNN NNNNNNNNNN NNNNNNNNNN
69851 NNNNNNNNNN NNNNNNNNNN NNNNNNNNNN NNNNNNNNNN NNNNNNNNNN
69901 NNNNNNNNNN NNNNNNNNNN NNNNNNNNNN NNNNNNNNNN NNNNNNNNNN
69951 NNNNNNNNNN NNNNNNNNNN NNNNNNNNNN NNNNNNNNNN NNNNNNNNNN
70001 NNNNNNNNNN NNNNNNNNNN NNNNNNNNNN NNNNNNNNNN NNNNNNNNNN
70051 NNNNNNNNNN NNNNNNNNNN NNNNNNNNNN NNNNNNNNNN NNNNNNNNNN
70101 NNNNNNNNNN NNNNNNNNNN NNNNNNNNNN NNNNNNNNNN NNNNNNNNNN
70151 NNNNNNNNNN NNNNNNNNNN NNNNNNNNNN NNNNNNNNNN NNNNNNNNNN
70201 NNNNNNNNNN NNNNNNNNNN NNNNNNNNNN NNNNNNNNNN NNNNNNNNNN
70251 NNNNNNNNNN NNNNNNNNNN NNNNNNNNNN NNNNNNNNNN NNNNNNNNNN
70301 NNNNNNNNNN NNNNNNNNNN NNNNNNNNNN NNNNNNNNNN NNNNNNNNNN
70351 NNNNNNNNNN NNNNNNNNNN NNNNNNNNNN NNNNNNNNNN NNNNNNNNNN
70401 NNNNNNNNNN NNNNNNNNNN NNNNNNNNNN NNNNNNNNNN NNNNNNNNNN
70451 NNNNNNNNNN NNNNNNNNNN NNNNNNNNNN NNNNNNNNNN NNNNNNNNNN
70501 NNNNNNNNNN NNNNNNNNNN NNNNNNNNNN NNNNNNNNNN NNNNNNNNNN
70551 NNNNNNNNNN NNNNNNNNNN NNNNNNNNNN NNNNNNNNNN NNNNNNNNNN
70601 NNNNNNNNNN NNNNNNNNNN NNNNNNNNNN NNNNNNNNNN NNNNNNNNNN
70651 NNNNNNNNNN NNNNNNNNNN NNNNNNNNNN NNNNNNNNNN NNNNNNNNNN
70701 NNNNNNNNNN NNNNNNNNNN NNNNNNNNNN NNNNNNNNNN NNNNNNNNNN
70751 NNNNNNNNNN NNNNNNNNNN NNNNNNNNNN NNNNNNNNNN NNNNNNNNNN
70801 NNNNNNNNNN NNNNNNNNNN NNNNNNNNNN NNNNNNNNNN NNNNNNNNNN
70851 NNNNNNNNNN NNNNNNNNNN NNNNNNNNNN NNNNNNNNNN NNNNNNNNNN
70901 NNNNNNNNNN NNNNNNNNNN NNNNNNNNNN NNNNNNNNNN NNNNNNNNNN
70951 NNNNNNNNNN NNNNNNNNNN NNNNNNNNNN NNNNNNNNNN NNNNNNNNNN
71001 NNNNNNNNNN NNNNNNNNNN NNNNNNNNNN NNNNNNNNNN NNNNNNNNNN
71051 NNNNNNNNNN NNNNNNNNNN NNNNNNNNNN NNNNNNNNNN NNNNNNNNNN
71101 NNNNNNNNNN NNNNNNNNNN NNNNNNNNNN NNNNNNNNNN NNNNNNNNNN
71151 NNNNNNNNNN NNNNNNNNNN NNNNNNNNNN NNNNNNNNNN NNNNNNNNNN
71201 NNNNNNNNNN NNNNNNNNNN NNNNNNNNNN NNNNNNNNNN NNNNNNNNNN
71251 NNNNNNNNNN NNNNNNNNNN NNNNNNNNNN NNNNNNNNNN NNNNNNNNNN
71301 NNNNNNNNNN NNNNNNNNNN NNNNNNNNNN NNNNNNNNNN NNNNNNNNNN
71351 NNNNNNNNNN NNNNNNNNNN NNNNNNNNNN NNNNNNNNNN NNNNNNNNNN

FIGURE 3U

71401 NNNNNNNNNN NNNNNNNNNN NNNNNNNNNN NNNNNNNNNN NNNNNNNNNN
71451 NNNNNNNNNN NNNNNNNNNN NNNNNNNNNN NNNNNNNNNN NNNNNNNNNN
71501 NNNNNNNNNN NNNNNNNNNN NNNNNNNNNN NNNNNNNNNN NNNNNNNNNN
71551 NNNNNNNNNN NNNNNNNNNN NNNNNNNNNN NNNNNNNNNN NNNNNNNNNN
71601 NNNNNNNNNN NNNNNNNNNN NNNNNNNNNN NNNNNNNNNN NNNNNNNNNN
71651 NNNNNNNNNN NNNNNNNNNN NNNNNNNNNN NNNNNNNNNN NNNNNNNNNN
71701 NNNNNNNNNN NNNNNNNNNN NNNNNNNNNN NNNNNNNNNN NNNNNNNNNN
71751 NNNNNNNNNN NNNNNNNNNN NNNNNNNNNN NNNNNNNNNN NNNNNNNNNN
71801 NNNNNNNNNN NNNNNNNNNN NNNNNNNNNN NNNNNNNNNN NNNNNNNNNN
71851 NNNNNNNNNN NNNNNNNNNN NNNNNNNNNN NNNNNNNNNN NNNNNNNNNN
71901 NNNNNNNNNN NNNNNNNNNN NNNNNNNNNN NNNNNNNNNN NNNNNNNNNN
71951 NNNNNNNNNN NNNNNNNNNN NNNNNNNNNN NNNNNNNNNN NNNNNNNNNN
72001 NNNNNNNNNN NNNNNNNNNN NNNNNNNNNN NNNNNNNNNN NNNNNNNNNN
72051 NNNNNNNNNN NNNNNNNNNN NNNNNNNNNN NNNNNNNNNN NNNNNNNNNN
72101 NNNNNNNNNN NNNNNNNNNN NNNNNNNNNN NNNNNNNNNN NNNNNNNNNN
72151 NNNNNNNNNN NNNNNNNNNN NNNNNNNNNN NNNNNNNNNN NNNNNNNNNN
72201 NNNNNNNNNN NNNNNNNNNN NNNNNNNNNN NNNNNNNNNN NNNNNNNNNN
72251 NNNNNNNNNN NNNNNNNNNN NNNNNNNNNN NNNNNNNNNN NNNNNNNNNN
72301 NNNNNNNNNN NNNNNNNNNN NNNNNNNNNN NNNNNNNNNN NNNNNNNNNN
72351 NNNNNNNNNN NNNNNNNNNN NNNNNNNNNN NNNNNNNNNN NNNNNNNNNN
72401 NNNNNNNNNN NNNNNNNNNN NNNNNNNNNN NNNNNNNNNN NNNNNNNNNN
72451 NNNNNNNNNN NNNNNNNNNN NNNNNNNNNN NNNNNNNNNN NNNNNNNNNN
72501 NNNNNNNNNN NNNNNNNNNN NNNNNNNNNN NNNNNNNNNN NNNNNNNNNN
72551 NNNNNNNNNN NNNNNNNNNN NNNNNNNNNN NNNNNNNNNN NNNNNNNNNN
72601 NNNNNNNNNN NNNNNNNNNN NNNNNNNNNN NNNNNNNNNN NNNNNNNNNN
72651 NNNNNNNNNN NNNNNNNNNN NNNNNNNNNN NNNNNNNNNN NNNNNNNNNN
72701 NNNNNNNNNN NNNNNNNNNN NNNNNNNNNN NNNNNNNNNN NNNNNNNNNN
72751 NNNNNNNNNN NNNNNNNNNN NNNNNNNNNN NNNNNNNNNN NNNNNNNNNN
72801 NNNNNNNNNN NNNNNNNNNN NNNNNNNNNN NNNNNNNNNN NNNNNNNNNN
72851 NNNNNNNNNN NNNNNNNNNN NNNNNNNNNN NNNNNNNNNN NNNNNNNNNN
72901 NNNNNNNNNN NNNNNNNNNN NNNNNNNNNN NNNNNNNNNN NNNNNNNNNN
72951 NNNNNNNNNN NNNNNNNNNN NNNNNNNNNN NNNNNNNNNN NNNNNNNNNN
73001 NNNNNNNNNN NNNNNNNNNN NNNNNNNNNN NNNNNNNNNN NNNNNNNNNN
73051 NNNNNNNNNN NNNNNNNNNN NNNNNNNNNN NNNNNNNNNN NNNNNNNNNN
73101 NNNNNNNNNN NNNNNNNNNN NNNNNNNNNN NNNNNNNNNN NNNNNNNNNN
73151 NNNNNNNNNN NNNNNNNNNN NNNNNNNNNN NNNNNNNNNN NNNNNNNNNN
73201 NNNNNNNNNN NNNNNNNNNN NNNNNNNNNN NNNNNNNNNN NNNNNNNNNN
73251 NNNNNNNNNN NNNNNNNNNN NNNNNNNNNN NNNNNNNNNN NNNNNNNNNN
73301 NNNNNNNNNN NNNNNNNNNN NNNNNNNNNN NNNNNNNNNN NNNNNNNNNN
73351 NNNNNNNNNN NNNNNNNNNN NNNNNNNNNN NNNNNNNNNN NNNNNNNNNN
73401 NNNNNNNNNN NNNNNNNNNN NNNNNNNNNN NNNNNNNNNN NNNNNNNNNN
73451 NNNNNNNNNN NNNNNNNNNN NNNNNNNNNN NNNNNNNNNN NNNNNNNNNN
73501 NNNNNNNNNN NNNNNNNNNN NNNNNNNNNN NNNNNNNNNN NNNNNNNNNN
73551 NNNNNNNNNN NNNNNNNNNN NNNNNNNNNN NNNNNNNNNN NNNNNNNNNN
73601 NNNNNNNNNN NNNNNNNNNN NNNNNNNNNN NNNNNNNNNN NNNNNNNNNN
73651 NNNNNNNNNN NNNNNNNNNN NNNNNNNNNN NNNNNNNNNN NNNNNNNNNN
73701 NNNNNNNNNN NNNNNNNNNN NNNNNNNNNN NNNNNNNNNN NNNNNNNNNN
73751 NNNNNNNNNN NNNNNNNNNN NNNNNNNNNN NNNNNNNNNN NNNNNNNNNN
73801 NNNNNNNNNN NNNNNNNNNN NNNNNNNNNN NNNNNNNNNN NNNNNNNNNN
73851 NNNNNNNNNN NNNNNNNNNN NNNNNNNNNN NNNNNNNNNN NNNNNNNNNN
73901 NNNNNNNNNN NNNNNNNNNN NNNNNNNNNN NNNNNNNNNN NNNNNNNNNN
73951 NNNNNNNNNN NNNNNNNNNN NNNNNNNNNN NNNNNNNNNN NNNNNNNNNN
74001 NNNNNNNNNN NNNNNNNNNN NNNNNNNNNN NNNNNNNNNN NNNNNNNNNN
74051 NNNNNNNNNN NNNNNNNNNN NNNNNNNNNN NNNNNNNNNN NNNNNNNNNN
74101 NNNNNNNNNN NNNNNNNNNN NNNNNNNNNN NNNNNNNNNN NNNNNNNNNN
74151 NNNNNNNNNN NNNNNNNNNN NNNNNNNNNN NNNNNNNNNN NNNNNNNNNN
74201 NNNNNNNNNN NNNNNNNNNN NNNNNNNNNN NNNNNNNNNN NNNNNNNNNN
74251 NNNNNNNNNN NNNNNNNNNN NNNNNNNNNN NNNNNNNNNN NNNNNNNNNN
74301 NNNNNNNNNN NNNNNNNNNN NNNNNNNNNN NNNNNNNNNN NNNNNNNNNN
74351 NNNNNNNNNN NNNNNNNNNN NNNNNNNNNN NNNNNNNNNN NNNNNNNNNN
74401 NNNNNNNNNN NNNNNNNNNN NNNNNNNNNN NNNNNNNNNN NNNNNNNNNN
74451 NNNNNNNNNN NNNNNNNNNN NNNNNNNNNN NNNNNNNNNN NNNNNNNNNN
74501 NNNNNNNNNN NNNNNNNNNN NNNNNNNNNN NNNNNNNNNN NNNNNNNNNN
74551 NNNNNNNNNN NNNNNNNNNN NNNNNNNNNN NNNNNNNNNN NNNNNNNNNN
74601 NNNNNNNNNN NNNNNNNNNN NNNNNNNNNN NNNNNNNNNN NNNNNNNNNN
74651 NNNNNNNNNN NNNNNNNNNN NNNNNNNNNN NNNNNNNNNN NNNNNNNNNN
74701 NNNNNNNNNN NNNNNNNNNN NNNNNNNNNN NNNNNNNNNN NNNNNNNNNN
74751 NNNNNNNNNN NNNNNNNNNN NNNNNNNNNN NNNNNNNNNN NNNNNNNNNN

FIGURE 3V

74801 NNNNNNNNNN NNNNNNNNNN NNNNNNNNNN NNNNNNNNNN NNNNNNNNNN
74851 NNNNNNNNNN NNNNNNNNNN NNNNNNNNNN NNNNNNNNNN NNNNNNNNNN
74901 NNNNNNNNNN NNNNNNNNNN NNNNNNNNNN NNNNNNNNNN NNNNNNNNNN
74951 NNNNNNNNNN NNNNNNNNNN NNNNNNNNNN NNNNNNNNNN NNNNNNNNNN
75001 NNNNNNNNNN NNNNNNNNNN NNNNNNNNNN NNNNNNNNNN NNNNNNNNNN
75051 NNNNNNNNNN NNNNNNNNNN NNNNNNNNNN NNNNNNNNNN NNNNNNNNNN
75101 NNNNNNNNNN NNNNNNNNNN NNNNNNNNNN NNNNNNNNNN NNNNNNNNNN
75151 NNNNNNNNNN NNNNNNNNNN NNNNNNNNNN NNNNNNNNNN NNNNNNNNNN
75201 NNNNNNNNNN NNNNNNNNNN NNNNNNNNNN NNNNNNNNNN NNNNNNNNNN
75251 NNNNNNNNNN NNNNNNNNNN NNNNNNNNNN NNNNNNNNNN NNNNNNNNNN
75301 NNNNNNNNNN NNNNNNNNNN NNNNNNNNNN NNNNNNNNNN NNNNNNNNNN
75351 NNNNNNNNNN NNNNNNNNNN NNNNNNNNNN NNNNNNNNNN NNNNNNNNNN
75401 NNNNNNNNNN NNNNNNNNNN NNNNNNNNNN NNNNNNNNNN NNNNNNNNNN
75451 NNNNNNNNNN NNNNNNNNNN NNNNNNNNNN NNNNNNNNNN NNNNNNNNNN
75501 NNNNNNNNNN NNNNNNNNNN NNNNNNNNNN NNNNNNNNNN NNNNNNNNNN
75551 NNNNNNNNNN NNNNNNNNNN NNNNNNNNNN NNNNNNNNNN NNNNNNNNNN
75601 NNNNNNNNNN NNNNNNNNNN NNNNNNNNNN NNNNNNNNNN NNNNNNNNNN
75651 NNNNNNNNNN NNNNNNNNNN NNNNNNNNNN NNNNNNNNNN NNNNNNNNNN
75701 NNNNNNNNNN NNNNNNNNNN NNNNNNNNNN NNNNNNNNNN NNNNNNNNNN
75751 NNNNNNNNNN NNNNNNNNNN NNNNNNNNNN NNNNNNNNNN NNNNNNNNNN
75801 NNNNNNNNNN NNNNNNNNNN NNNNNNNNNN NNNNNNNNNN NNNNNNNNNN
75851 NNNNNNNNNN NNNNNNNNNN NNNNNNNNNN NNNNNNNNNN NNNNNNNNNN
75901 NNNNNNNNNN NNNNNNNNNN NNNNNNNNNN NNNNNNNNNN NNNNNNNNNN
75951 NNNNNNNNNN NNNNNNNNNN NNNNNNNNNN NNNNNNNNNN NNNNNNNNNN
76001 NNNNNNNNNN NNNNNNNNNN NNNNNNNNNN NNNNNNNNNN NNNNNNNNNN
76051 NNNNNNNNNN NNNNNNNNNN NNNNNNNNNN NNNNNNNNNN NNNNNNNNNN
76101 NNNNNNNNNN NNNNNNNNNN NNNNNNNNNN NNNNNNNNNN NNNNNNNNNN
76151 NNNNNNNNNN NNNNNNNNNN NNNNNNNNNN NNNNNNNNNN NNNNNNNNNN
76201 NNNNNNNNNN NNNNNNNNNN NNNNNNNNNN NNNNNNNNNN NNNNNNNNNN
76251 NNNNNNNNNN NNNNNNNNNN NNNNNNNNNN NNNNNNNNNN NNNNNNNNNN
76301 NNNNNNNNNN NNNNNNNNNN NNNNNNNNNN NNNNNNNNNN NNNNNNNNNN
76351 NNNNNNNNNN NNNNNNNNNN NNNNNNNNNN NNNNNNNNNN NNNNNNNNNN
76401 NNNNNNNNNN NNNNNNNNNN NNNNNNNNNN NNNNNNNNNN NNNNNNNNNN
76451 NNNNNNNNNN NNNNNNNNNN NNNNNNNNNN NNNNNNNNNN NNNNNNNNNN
76501 NNNNNNNNNN NNNNNNNNNN NNNNNNNNNN NNNNNNNNNN NNNNNNNNNN
76551 NNNNNNNNNN NNNNNNNNNN NNNNNNNNNN NNNNNNNNNN NNNNNNNNNN
76601 NNNNNNNNNN NNNNNNNNNN NNNNNNNNNN NNNNNNNNNN NNNNNNNNNN
76651 NNNNNNNNNN NNNNNNNNNN NNNNNNNNNN NNNNNNNNNN NNNNNNNNNN
76701 NNNNNNNNNN NNNNNNNNNN NNNNNNNNNN NNNNNNNNNN NNNNNNNNNN
76751 NNNNNNNNNN NNNNNNNNNN NNNNNNNNNN NNNNNNNNNN NNNNNNNNNN
76801 NNNNNNNNNN NNNNNNNNNN NNNNNNNNNN NNNNNNNNNN NNNNNNNNNN
76851 NNNNNNNNNN NNNNNNNNNN NNNNNNNNNN NNNNNNNNNN NNNNNNNNNN
76901 NNNNNNNNNN NNNNNNNNNN NNNNNNNNNN NNNNNNNNNN NNNNNNNNNN
76951 NNNNNNNNNN NNNNNNNNNN NNNNNNNNNN NNNNNNNNNN NNNNNNNNNN
77001 NNNNNNNNNN NNNNNNNNNN NNNNNNNNNN NNNNNNNNNN NNNNNNNNNN
77051 NNNNNNNNNN NNNNNNNNNN NNNNNNNNNN NNNNNNNNNN NNNNNNNNNN
77101 NNNNNNNNNN NNNNNNNNNN NNNNNNNNNN NNNNNNNNNN NNNNNNNNNN
77151 NNNNNNNNNN NNNNNNNNNN NNNNNNNNNN NNNNNNNNNN NNNNNNNNNN
77201 NNNNNNNNNN NNNNNNNNNN NNNNNNNNNN NNNNNNNNNN NNNNNNNNNN
77251 NNNNNNNNNN NNNNNNNNNN NNNNNNNNNN NNNNNNNNNN NNNNNNNNNN
77301 NNNNNNNNNN NNNNNNNNNN NNNNNNNNNN NNNNNNNNNN NNNNNNNNNN
77351 NNNNNNNNNN NNNNNNNNNN NNNNNNNNNN NNNNNNNNNN NNNNNNNNNN
77401 NNNNNNNNNN NNNNNNNNNN NNNNNNNNNN NNNNNNNNNN NNNNNNNNNN
77451 NNNNNNNNNN NNNNNNNNNN NNNNNNNNNN NNNNNNNNNN NNNNNNNNNN
77501 NNNNNNNNNN NNNNNNNNNN NNNNNNNNNN NNNNNNNNNN NNNNNNNNNN
77551 NNNNNNNNNN NNNNNNNNNN NNNNNNNNNN NNNNNNNNNN NNNNNNNNNN
77601 NNNNNNNNNN NNNNNNNNNN NNNNNNNNNN NNNNNNNNNN NNNNNNNNNN
77651 NNNNNNNNNN NNNNNNNNNN NNNNNNNNNN NNNNNNNNNN NNNNNNNNNN
77701 NNNNNNNNNN NNNNNNNNNN NNNNNNNNNN NNNNNNNNNN NNNNNNNNNN
77751 NNNNNNNNNN NNNNNNNNNN NNNNNNNNNN NNNNNNNNNN NNNNNNNNNN
77801 NNNNNNNNNN NNNNNNNNNN NNNNNNNNNN NNNNNNNNNN NNNNNNNNNN
77851 NNNNNNNNNN NNNNNNNNNN NNNNNNNNNN NNNNNNNNNN NNNNNNNNNN
77901 NNNNNNNNNN NNNNNNNNNN NNNNNNNNNN NNNNNNNNNN NNNNNNNNNN
77951 NNNNNNNNNN NNNNNNNNNN NNNNNNNNNN NNNNNNNNNN NNNNNNNNNN
78001 NNNNNNNNNN NNNNNNNNNN NNNNNNNNNN NNNNNNNNNN NNNNNNNNNN
78051 NNNNNNNNNN NNNNNNNNNN NNNNNNNNNN NNNNNNNNNN NNNNNNNNNN
78101 NNNNNNNNNN NNNNNNNNNN NNNNNNNNNN NNNNNNNNNN NNNNNNNNNN
78151 NNNNNNNNNN NNNNNNNNNN NNNNNNNNNN NNNNNNNNNN NNNNNNNNNN

FIGURE 3W

78201 NNNNNNNNNN NNNNNNNNNN NNNNNNNNNN NNNNNNNNNN NNNNNNNNNN
78251 NNNNNNNNNN NNNNNNNNNN NNNNNNNNNN NNNNNNNNNN NNNNNNNNNN
78301 NNNNNNNNNN NNNNNNNNNN NNNNNNNNNN NNNNNNNNNN NNNNNNNNNN
78351 NNNNNNNNNN NNNNNNNNNN NNNNNNNNNN NNNNNNNNNN NNNNNNNNNN
78401 NNNNNNNNNN NNNNNNNNNN NNNNNNNNNN NNNNNNNNNN NNNNNNNNNN
78451 NNNNNNNNNN NNNNNNNNNN NNNNNNNNNN NNNNNNNNNN NNNNNNNNNN
78501 NNNNNNNNNN NNNNNNNNNN NNNNNNNNNN NNNNNNNNNN NNNNNNNNNN
78551 NNNNNNNNNN NNNNNNNNNN NNNNNNNNNN NNNNNNNNNN NNNNNNNNNN
78601 NNNNNNNNNN NNNNNNNNNN NNNNNNNNNN NNNNNNNNNN NNNNNNNNNN
78651 NNNNNNNNNN NNNNNNNNNN NNNNNNNNNN NNNNNNNNNN NNNNNNNNNN
78701 NNNNNNNNNN NNNNNNNNNN NNNNNNNNNN NNNNNNNNNN NNNNNNNNNN
78751 NNNNNNNNNN NNNNNNNNNN NNNNNNNNNN NNNNNNNNNN NNNNNNNNNN
78801 NNNNNNNNNN NNNNNNNNNN NNNNNNNNNN NNNNNNNNNN NNNNNNNNNN
78851 NNNNNNNNNN NNNNNNNNNN NNNNNNNNNN NNNNNNNNNN NNNNNNNNNN
78901 NNNNNNNNNN NNNNNNNNNN NNNNNNNNNN NNNNNNNNNN NNNNNNNNNN
78951 NNNNNNNNNN NNNNNNNNNN NNNNNNNNNN NNNNNNNNNN NNNNNNNNNN
79001 NNNNNNNNNN NNNNNNNNNN NNNNNNNNNN NNNNNNNNNN NNNNNNNNNN
79051 NNNNNNNNNN NNNNNNNNNN NNNNNNNNNN NNNNNNNNNN NNNNNNNNNN
79101 NNNNNNNNNN NNNNNNNNNN NNNNNNNNNN NNNNNNNNNN NNNNNNNNNN
79151 NNNNNNNNNN NNNNNNNNNN NNNNNNNNNN NNNNNNNNNN NNNNNNNNNN
79201 NNNNNNNNNN NNNNNNNNNN NNNNNNNNNN NNNNNNNNNN NNNNNNNNNN
79251 NNNNNNNNNN NNNNNNNNNN NNNNNNNNNN NNNNNNNNNN NNNNNNNNNN
79301 NNNNNNNNNN NNNNNNNNNN NNNNNNNNNN NNNNNNNNNN NNNNNNNNNN
79351 NNNNNNNNNN NNNNNNNNNN NNNNNNNNNN NNNNNNNNNN NNNNNNNNNN
79401 NNNNNNNNNN NNNNNNNNNN NNNNNNNNNN NNNNNNNNNN NNNNNNNNNN
79451 NNNNNNNNNN NNNNNNNNNN NNNNNNNNNN NNNNNNNNNN NNNNNNNNNN
79501 NNNNNNNNNN NNNNNNNNNN NNNNNNNNNN NNNNNNNNNN NNNNNNNNNN
79551 NNNNNNNNNN NNNNNNNNNN NNNNNNNNNN NNNNNNNNNN NNNNNNNNNN
79601 NNNNNNNNNN NNNNNNNNNN NNNNNNNNNN NNNNNNNNNN NNNNNNNNNN
79651 NNNNNNNNNN NNNNNNNNNN NNNNNNNNNN NNNNNNNNNN NNNNNNNNNN
79701 NNNNNNNNNN NNNNNNNNNN NNNNNNNNNN NNNNNNNNNN NNNNNNNNNN
79751 NNNNNNNNNN NNNNNNNNNN NNNNNNNNNN NNNNNNNNNN NNNNNNNNNN
79801 NNNNNNNNNN NNNNNNNNNN NNNNNNNNNN NNNNNNNNNN NNNNNNNNNN
79851 NNNNNNNNNN NNNNNNNNNN NNNNNNNNNN NNNNNNNNNN NNNNNNNNNN
79901 NNNNNNNNNN NNNNNNNNNN NNNNNNNNNN NNNNNNNNNN NNNNNNNNNN
79951 NNNNNNNNNN NNNNNNNNNN NNNNNNNNNN NNNNNNNNNN NNNNNNNNNN
80001 NNNNNNNNNN NNNNNNNNNN NNNNNNNNNN NNNNNNNNNN NNNNNNNNNN
80051 NNNNNNNNNN NNNNNNNNNN NNNNNNNNNN NNNNNNNNNN NNNNNNNNNN
80101 NNNNNNNNNN NNNNNNNNNN NNNNNNNNNN NNNNNNNNNN NNNNNNNNNN
80151 NNNNNNNNNN NNNNNNNNNN NNNNNNNNNN NNNNNNNNNN NNNNNNNNNN
80201 NNNNNNNNNN NNNNNNNNNN NNNNNNNNNN NNNNNNNNNN NNNNNNNNNN
80251 NNNNNNNNNN NNNNNNNNNN NNNNNNNNNN NNNNNNNNNN NNNNNNNNNN
80301 NNNNNNNNNN NNNNNNNNNN NNNNNNNNNN NNNNNNNNNN NNNNNNNNNN
80351 NNNNNNNNNN NNNNNNNNNN NNNNNNNNNN NNNNNNNNNN NNNNNNNNNN
80401 NNNNNNNNNN NNNNNNNNNN NNNNNNNNNN NNNNNNNNNN NNNNNNNNNN
80451 NNNNNNNNNN NNNNNNNNNN NNNNNNNNNN NNNNNNNNNN NNNNNNNNNN
80501 NNNNNNNNNN NNNNNNNNNN NNNNNNNNNN NNNNNNNNNN NNNNNNNNNN
80551 NNNNNNNNNN NNNNNNNNNN NNNNNNNNNN NNNNNNNNNN NNNNNNNNNN
80601 NNNNNNNNNN NNNNNNNNNN NNNNNNNNNN NNNNNNNNNN NNNNNNNNNN
80651 NNNNNNNNNN NNNNNNNNNN NNNNNNNNNN NNNNNNNNNN NNNNNNNNNN
80701 NNNNNNNNNN NNNNNNNNNN NNNNNNNNNN NNNNNNNNNN NNNNNNNNNN
80751 NNNNNNNNNN NNNNNNNNNN NNNNNNNNNN NNNNNNNNNN NNNNNNNNNN
80801 NNNNNNNNNN NNNNNNNNNN NNNNNNNNNN NNNNNNNNNN NNNNNNNNNN
80851 NNNNNNNNNN NNNNNNNNNN NNNNNNNNNN NNNNNNNNNN NNNNNNNNNN
80901 NNNNNNNNNN NNNNNNNNNN NNNNNNNNNN NNNNNNNNNN NNNNNNNNNN
80951 NNNNNNNNNN NNNNNNNNNN NNNNNNNNNN NNNNNNNNNN NNNNNNNNNN
81001 NNNNNNNNNN NNNNNNNNNN NNNNNNNNNN NNNNNNNNNN NNNNNNNNNN
81051 NNNNNNNNNN NNNNNNNNNN NNNNNNNNNN NNNNNNNNNN NNNNNNNNNN
81101 NNNNNNNNNN NNNNNNNNNN NNNNNNNNNN NNNNNNNNNN NNNNNNNNNN
81151 NNNNNNNNNN NNNNNNNNNN NNNNNNNNNN NNNNNNNNNN NNNNNNNNNN
81201 NNNNNNNNNN NNNNNNNNNN NNNNNNNNNN NNNNNNNNNN NNNNNNNNNN
81251 NNNNNNNNNN NNNNNNNNNN NNNNNNNNNN NNNNNNNNNN NNNNNNNNNN
81301 NNNNNNNNNN NNNNNNNNNN NNNNNNNNNN NNNNNNNNNN NNNNNNNNNN
81351 NNNNNNNNNN NNNNNNNNNN NNNNNNNNNN NNNNNNNNNN NNNNNNNNNN
81401 NNNNNNNNNN NNNNNNNNNN NNNNNNNNNN NNNNNNNNNN NNNNNNNNNN
81451 NNNNNNNNNN NNNNNNNNNN NNNNNNNNNN NNNNNNNNNN NNNNNNNNNN
81501 NNNNNNNNNN NNNNNNNNNN NNNNNNNNNN NNNNNNNNNN NNNNNNNNNN
81551 NNNNNNNNNN NNNNNNNNNN NNNNNNNNNN NNNNNNNNNN NNNNNNNNNN

FIGURE 3X

81601 NNNNNNNNNN NNNNNNNNNN NNNNNNNNNN NNNNNNNNNN NNNNNNNNNN
81651 NNNNNNNNNN NNNNNNNNNN NNNNNNNNNN NNNNNNNNNN NNNNNNNNNN
81701 NNNNNNNNNN NNNNNNNNNN NNNNNNNNNN NNNNNNNNNN NNNNNNNNNN
81751 NNNNNNNNNN NNNNNNNNNN NNNNNNNNNN NNNNNNNNNN NNNNNNNNNN
81801 NNNNNNNNNN NNNNNNNNNN NNNNNNNNNN NNNNNNNNNN NNNNNNNNNN
81851 NNNNNNNNNN NNNNNNNNNN NNNNNNNNNN NNNNNNNNNN NNNNNNNNNN
81901 NNNNNNNNNN NNNNNNNNNN NNNNNNNNNN NNNNNNNNNN NNNNNNNNNN
81951 NNNNNNNNNN NNNNNNNNNN NNNNNNNNNN NNNNNNNNNN NNNNNNNNNN
82001 NNNNNNNNNN NNNNNNNNNN NNNNNNNNNN NNNNNNNNNN NNNNNNNNNN
82051 NNNNNNNNNN NNNNNNNNNN NNNNNNNNNN NNNNNNNNNN NNNNNNNNNN
82101 NNNNNNNNNN NNNNNNNNNN NNNNNNNNNN NNNNNNNNNN NNNNNNNNNN
82151 NNNNNNNNNN NNNNNNNNNN NNNNNNNNNN NNNNNNNNNN NNNNNNNNNN
82201 NNNNNNNNNN NNNNNNNNNN NNNNNNNNNN NNNNNNNNNN NNNNNNNNNN
82251 NNNNNNNNNN NNNNNNNNNN NNNNNNNNNN NNNNNNNNNN NNNNNNNNNN
82301 NNNNNNNNNN NNNNNNNNNN NNNNNNNNNN NNNNNNNNNN NNNNNNNNNN
82351 NNNNNNNNNN NNNNNNNNNN NNNNNNNNNN NNNNNNNNNN NNNNNNNNNN
82401 NNNNNNNNNN NNNNNNNNNN NNNNNNNNNN NNNNNNNNNN NNNNNNNNNN
82451 NNNNNNNNNN NNNNNNNNNN NNNNNNNNNN NNNNNNNNNN NNNNNNNNNN
82501 NNNNNNNNNN NNNNNNNNNN NNNNNNNNNN NNNNNNNNNN NNNNNNNNNN
82551 NNNNNNNNNN NNNNNNNNNN NNNNNNNNNN NNNNNNNNNN NNNNNNNNNN
82601 NNNNNNNNNN NNNNNNNNNN NNNNNNNNNN NNNNNNNNNN NNNNNNNNNN
82651 NNNNNNNNNN NNNNNNNNNN NNNNNNNNNN NNNNNNNNNN NNNNNNNNNN
82701 NNNNNNNNNN NNNNNNNNNN NNNNNNNNNN NNNNNNNNNN NNNNNNNNNN
82751 NNNNNNNNNN NNNNNNNNNN NNNNNNNNNN NNNNNNNNNN NNNNNNNNNN
82801 NNNNNNNNNN NNNNNNNNNN NNNNNNNNNN NNNNNNNNNN NNNNNNNNNN
82851 NNNNNNNNNN NNNNNNNNNN NNNNNNNNNN NNNNNNNNNN NNNNNNNNNN
82901 NNNNNNNNNN NNNNNNNNNN NNNNNNNNNN NNNNNNNNNN NNNNNNNNNN
82951 NNNNNNNNNN NNNNNNNNNN NNNNNNNNNN NNNNNNNNNN NNNNNNNNNN
83001 NNNNNNNNNN NNNNNNNNNN NNNNNNNNNN NNNNNNNNNN NNNNNNNNNN
83051 NNNNNNNNNN NNNNNNNNNN NNNNNNNNNN NNNNNNNNNN NNNNNNNNNN
83101 NNNNNNNNNN NNNNNNNNNN NNNNNNNNNN NNNNNNNNNN NNNNNNNNNN
83151 NNNNNNNNNN NNNNNNNNNN NNNNNNNNNN NNNNNNNNNN NNNNNNNNNN
83201 NNNNNNNNNN NNNNNNNNNN NNNNNNNNNN NNNNNNNNNN NNNNNNNNNN
83251 NNNNNNNNNN NNNNNNNNNN NNNNNNNNNN NNNNNNNNNN NNNNNNNNNN
83301 NNNNNNNNNN NNNNNNNNNN NNNNNNNNNN NNNNNNNNNN NNNNNNNNNN
83351 NNNNNNNNNN NNNNNNNNNN NNNNNNNNNN NNNNNNNNNN NNNNNNNNNN
83401 NNNNNNNNNN NNNNNNNNNN NNNNNNNNNN NNNNNNNNNN NNNNNNNNNN
83451 NNNNNNNNNN NNNNNNNNNN NNNNNNNNNN NNNNNNNNNN NNNNNNNNNN
83501 NNNNNNNNNN NNNNNNNNNN NNNNNNNNNN NNNNNNNNNN NNNNNNNNNN
83551 NNNNNNNNNN NNNNNNNNNN NNNNNNNNNN NNNNNNNNNN NNNNNNNNNN
83601 NNNNNNNNNN NNNNNNNNNN NNNNNNNNNN NNNNNNNNNN NNNNNNNNNN
83651 NNNNNNNNNN NNNNNNNNNN NNNNNNNNNN NNNNNNNNNN NNNNNNNNNN
83701 NNNNNNNNNN NNNNNNNNNN NNNNNNNNNN NNNNNNNNNN NNNNNNNNNN
83751 NNNNNNNNNN NNNNNNNNNN NNNNNNNNNN NNNNNNNNNN NNNNNNNNNN
83801 NNNNNNNNNN NNNNNNNNNN NNNNNNNNNN NNNNNNNNNN NNNNNNNNNN
83851 NNNNNNNNNN NNNNNNNNNN NNNNNNNNNN NNNNNNNNNN NNNNNNNNNN
83901 NNNNNNNNNN NNNNNNNNNN NNNNNNNNNN NNNNNNNNNN NNNNNNNNNN
83951 NNNNNNNNNN NNNNNNNNNN NNNNNNNNNN NNNNNNNNNN NNNNNNNNNN
84001 NNNNNNNNNN NNNNNNNNNN NNNNNNNNNN NNNNNNNNNN NNNNNNNNNN
84051 NNNNNNNNNN NNNNNNNNNN NNNNNNNNNN NNNNNNNNNN NNNNNNNNNN
84101 NNNNNNNNNN NNNNNNNNNN NNNNNNNNNN NNNNNNNNNN NNNNNNNNNN
84151 NNNNNNNNNN NNNNNNNNNN NNNNNNNNNN NNNNNNNNNN NNNNNNNNNN
84201 NNNNNNNNNN NNNNNNNNNN NNNNNNNNNN NNNNNNNNNN NNNNNNNNNN
84251 NNNNNNNNNN NNNNNNNNNN NNNNNNNNNN NNNNNNNNNN NNNNNNNNNN
84301 NNNNNNNNNN NNNNNNNNNN NNNNNNNNNN NNNNNNNNNN NNNNNNNNNN
84351 NNNNNNNNNN NNNNNNNNNN NNNNNNNNNN NNNNNNNNNN NNNNNNNNNN
84401 NNNNNNNNNN NNNNNNNNNN NNNNNNNNNN NNNNNNNNNN NNNNNNNNNN
84451 NNNNNNNNNN NNNNNNNNNN NNNNNNNNNN NNNNNNNNNN NNNNNNNNNN
84501 NNNNNNNNNN NNNNNNNNNN NNNNNNNNNN NNNNNNNNNN NNNNNNNNNN
84551 NNNNNNNNNN NNNNNNNNNN NNNNNNNNNN NNNNNNNNNN NNNNNNNNNN
84601 NNNNNNNNNN NNNNNNNNNN NNNNNNNNNN NNNNNNNNNN NNNNNNNNNN
84651 NNNNNNNNNN NNNNNNNNNN NNNNNNNNNN NNNNNNNNNN NNNNNNNNNN
84701 NNNNNNNNNN NNNNNNNNNN NNNNNNNNNN NNNNNNNNNN NNNNNNNNNN
84751 NNNNNNNNNN NNNNNNNNNN NNNNNNNNNN NNNNNNNNNN NNNNNNNNNN
84801 NNNNNNNNNN NNNNNNNNNN NNNNNNNNNN NNNNNNNNNN NNNNNNNNNN
84851 NNNNNNNNNN NNNNNNNNNN NNNNNNNNNN NNNNNNNNNN NNNNNNNNNN
84901 NNNNNNNNNN NNNNNNNNNN NNNNNNNNNN NNNNNNNNNN NNNNNNNNNN
84951 NNNNNNNNNN NNNNNNNNNN NNNNNNNNNN NNNNNNNNNN NNNNNNNNNN

FIGURE 3Y

85001 NNNNNNNNNN NNNNNNNNNN NNNNNNNNNN NNNNNNNNNN NNNNNNNNNN
85051 NNNNNNNNNN NNNNNNNNNN NNNNNNNNNN NNNNNNNNNN NNNNNNNNNN
85101 NNNNNNNNNN NNNNNNNNNN NNNNNNNNNN NNNNNNNNNN NNNNNNNNNN
85151 NNNNNNNNNN NNNNNNNNNN NNNNNNNNNN NNNNNNNNNN NNNNNNNNNN
85201 NNNNNNNNNN NNNNNNNNNN NNNNNNNNNN NNNNNNNNNN NNNNNNNNNN
85251 NNNNNNNNNN NNNNNNNNNN NNNNNNNNNN NNNNNNNNNN NNNNNNNNNN
85301 NNNNNNNNNN NNNNNNNNNN NNNNNNNNNN NNNNNNNNNN NNNNNNNNNN
85351 NNNNNNNNNN NNNNNNNNNN NNNNNNNNNN NNNNNNNNNN NNNNNNNNNN
85401 NNNNNNNNNN NNNNNNNNNN NNNNNNNNNN NNNNNNNNNN NNNNNNNNNN
85451 NNNNNNNNNN NNNNNNNNNN NNNNNNNNNN NNNNNNNNNN NNNNNNNNNN
85501 NNNNNNNNNN NNNNNNNNNN NNNNNNNNNN NNNNNNNNNN NNNNNNNNNN
85551 NNNNNNNNNN NNNNNNNNNN NNNNNNNNNN NNNNNNNNNN NNNNNNNNNN
85601 NNNNNNNNNN NNNNNNNNNN NNNNNNNNNN NNNNNNNNNN NNNNNNNNNN
85651 NNNNNNNNNN NNNNNNNNNN NNNNNNNNNN NNNNNNNNNN NNNNNNNNNN
85701 NNNNNNNNNN NNNNNNNNNN NNNNNNNNNN NNNNNNNNNN NNNNNNNNNN
85751 NNNNNNNNNN NNNNNNNNNN NNNNNNNNNN NNNNNNNNNN NNNNNNNNNN
85801 NNNNNNNNNN NNNNNNNNNN NNNNNNNNNN NNNNNNNNNN NNNNNNNNNN
85851 NNNNNNNNNN NNNNNNNNNN NNNNNNNNNN NNNNNNNNNN NNNNNNNNNN
85901 NNNNNNNNNN NNNNNNNNNN NNNNNNNNNN NNNNNNNNNN NNNNNNNNNN
85951 NNNNNNNNNN NNNNNNNNNN NNNNNNNNNN NNNNNNNNNN NNNNNNNNNN
86001 NNNNNNNNNN NNNNNNNNNN NNNNNNNNNN NNNNNNNNNN NNNNNNNNNN
86051 NNNNNNNNNN NNNNNNNNNN NNNNNNNNNN NNNNNNNNNN NNNNNNNNNN
86101 NNNNNNNNNN NNNNNNNNNN NNNNNNNNNN NNNNNNNNNN NNNNNNNNNN
86151 NNNNNNNNNN NNNNNNNNNN NNNNNNNNNN NNNNNNNNNN NNNNNNNNNN
86201 NNNNNNNNNN NNNNNNNNNN NNNNNNNNNN NNNNNNNNNN NNNNNNNNNN
86251 NNNNNNNNNN NNNNNNNNNN NNNNNNNNNN NNNNNNNNNN NNNNNNNNNN
86301 NNNNNNNNNN NNNNNNNNNN NNNNNNNNNN NNNNNNNNNN NNNNNNNNNN
86351 NNNNNNNNNN NNNNNNNNNN NNNNNNNNNN NNNNNNNNNN NNNNNNNNNN
86401 NNNNNNNNNN NNNNNNNNNN NNNNNNNNNN NNNNNNNNNN NNNNNNNNNN
86451 NNNNNNNNNN NNNNNNNNNN NNNNNNNNNN NNNNNNNNNN NNNNNNNNNN
86501 NNNNNNNNNN NNNNNNNNNN NNNNNNNNNN NNNNNNNNNN NNNNNNNNNN
86551 NNNNNNNNNN NNNNNNNNNN NNNNNNNNNN NNNNNNNNNN NNNNNNNNNN
86601 NNNNNNNNNN NNNNNNNNNN NNNNNNNNNN NNNNNNNNNN NNNNNNNNNN
86651 NNNNNNNNNN NNNNNNNNNN NNNNNNNNNN NNNNNNNNNN NNNNNNNNNN
86701 NNNNNNNNNN NNNNNNNNNN NNNNNNNNNN NNNNNNNNNN NNNNNNNNNN
86751 NNNNNNNNNN NNNNNNNNNN NNNNNNNNNN NNNNNNNNNN NNNNNNNNNN
86801 NNNNNNNNNN NNNNNNNNNN NNNNNNNNNN NNNNNNNNNN NNNNNNNNNN
86851 NNNNNNNNNN NNNNNNNNNN NNNNNNNNNN NNNNNNNNNN NNNNNNNNNN
86901 NNNNNNNNNN NNNNNNNNNN NNNNNNNNNN NNNNNNNNNN NNNNNNNNNN
86951 NNNNNNNNNN NNNNNNNNNN NNNNNNNNNN NNNNNNNNNN NNNNNNNNNN
87001 NNNNNNNNNN NNNNNNNNNN NNNNNNNNNN NNNNNNNNNN NNNNNNNNNN
87051 NNNNNNNNNN NNNNNNNNNN NNNNNNNNNN NNNNNNNNNN NNNNNNNNNN
87101 NNNNNNNNNN NNNNNNNNNN NNNNNNNNNN NNNNNNNNNN NNNNNNNNNN
87151 NNNNNNNNNN NNNNNNNNNN NNNNNNNNNN NNNNNNNNNN NNNNNNNNNN
87201 NNNNNNNNNN NNNNNNNNNN NNNNNNNNNN NNNNNNNNNN NNNNNNNNNN
87251 NNNNNNNNNN NNNNNNNNNN NNNNNNNNNN NNNNNNNNNN NNNNNNNNNN
87301 NNNNNNNNNN NNNNNNNNNN NNNNNNNNNN NNNNNNNNNN NNNNNNNNNN
87351 NNNNNNNNNN NNNNNNNNNN NNNNNNNNNN NNNNNNNNNN NNNNNNNNNN
87401 NNNNNNNNNN NNNNNNNNNN NNNNNNNNNN NNNNNNNNNN NNNNNNNNNN
87451 NNNNNNNNNN NNNNNNNNNN NNNNNNNNNN NNNNNNNNNN NNNNNNNNNN
87501 NNNNNNNNNN NNNNNNNNNN NNNNNNNNNN NNNNNNNNNN NNNNNNNNNN
87551 NNNNNNNNNN NNNNNNNNNN NNNNNNNNNN NNNNNNNNNN NNNNNNNNNN
87601 NNNNNNNNNN NNNNNNNNNN NNNNNNNNNN NNNNNNNNNN NNNNNNNNNN
87651 NNNNNNNNNN NNNNNNNNNN NNNNNNNNNN NNNNNNNNNN NNNNNNNNNN
87701 NNNNNNNNNN NNNNNNNNNN NNNNNNNNNN NNNNNNNNNN NNNNNNNNNN
87751 NNNNNNNNNN NNNNNNNNNN NNNNNNNNNN NNNNNNNNNN NNNNNNNNNN
87801 NNNNNNNNNN NNNNNNNNNN NNNNNNNNNN NNNNNNNNNN NNNNNNNNNN
87851 NNNNNNNNNN NNNNNNNNNN NNNNNNNNNN NNNNNNNNNN NNNNNNNNNN
87901 NNNNNNNNNN NNNNNNNNNN NNNNNNNNNN NNNNNNNNNN NNNNNNNNNN
87951 NNNNNNNNNN NNNNNNNNNN NNNNNNNNNN NNNNNNNNNN NNNNNNNNNN
88001 NNNNNNNNNN NNNNNNNNNN NNNNNNNNNN NNNNNNNNNN NNNNNNNNNN
88051 NNNNNNNNNN NNNNNNNNNN NNNNNNNNNN NNNNNNNNNN NNNNNNNNNN
88101 NNNNNNNNNN NNNNNNNNNN NNNNNNNNNN NNNNNNNNNN NNNNNNNNNN
88151 NNNNNNNNNN NNNNNNNNNN NNNNNNNNNN NNNNNNNNNN NNNNNNNNNN
88201 NNNNNNNNNN NNNNNNNNNN NNNNNNNNNN NNNNNNNNNN NNNNNNNNNN
88251 NNNNNNNNNN NNNNNNNNNN NNNNNNNNNN NNNNNNNNNN NNNNNNNNNN
88301 NNNNNNNNNN NNNNNNNNNN NNNNNNNNNN NNNNNNNNNN NNNNNNNNNN
88351 NNNNNNNNNN NNNNNNNNNN NNNNNNNNNN NNNNNNNNNN NNNNNNNNNN

FIGURE 3Z

88401 NNNNNNNNNN NNNNNNNNNN NNNNNNNNNN NNNNNNNNNN NNNNNNNNNN
88451 NNNNNNNNNN NNNNNNNNNN NNNNNNNNNN NNNNNNNNNN NNNNNNNNNN
88501 NNNNNNNNNN NNNNNNNNNN NNNNNNNNNN NNNNNNNNNN NNNNNNNNNN
88551 NNNNNNNNNN NNNNNNNNNN NNNNNNNNNN NNNNNNNNNN NNNNNNNNNN
88601 NNNNNNNNNN NNNNNNNNNN NNNNNNNNNN NNNNNNNNNN NNNNNNNNNN
88651 NNNNNNNNNN NNNNNNNNNN NNNNNNNNNN NNNNNNNNNN NNNNNNNNNN
88701 NNNNNNNNNN NNNNNNNNNN NNNNNNNNNN NNNNNNNNNN NNNNNNNNNN
88751 NNNNNNNNNN NNNNNNNNNN NNNNNNNNNN NNNNNNNNNN NNNNNNNNNN
88801 NNNNNNNNNN NNNNNNNNNN NNNNNNNNNN NNNNNNNNNN NNNNNNNNNN
88851 NNNNNNNNNN NNNNNNNNNN NNNNNNNNNN NNNNNNNNNN NNNNNNNNNN
88901 NNNNNNNNNN NNNNNNNNNN NNNNNNNNNN NNNNNNNNNN NNNNNNNNNN
88951 NNNNNNNNNN NNNNNNNNNN NNNNNNNNNN NNNNNNNNNN NNNNNNNNNN
89001 NNNNNNNNNN NNNNNNNNNN NNNNNNNNNN NNNNNNNNNN NNNNNNNNNN
89051 NNNNNNNNNN NNNNNNNNNN NNNNNNNNNN NNNNNNNNNN NNNNNNNNNN
89101 NNNNNNNNNN NNNNNNNNNN NNNNNNNNNN NNNNNNNNNN NNNNNNNNNN
89151 NNNNNNNNNN NNNNNNNNNN NNNNNNNNNN NNNNNNNNNN NNNNNNNNNN
89201 NNNNNNNNNN NNNNNNNNNN NNNNNNNNNN NNNNNNNNNN NNNNNNNNNN
89251 NNNNNNNNNN NNNNNNNNNN NNNNNNNNNN NNNNNNNNNN NNNNNNNNNN
89301 NNNNNNNNNN NNNNNNNNNN NNNNNNNNNN NNNNNNNNNN NNNNNNNNNN
89351 NNNNNNNNNN NNNNNNNNNN NNNNNNNNNN NNNNNNNNNN NNNNNNNNNN
89401 NNNNNNNNNN NNNNNNNNNN NNNNNNNNNN NNNNNNNNNN NNNNNNNNNN
89451 NNNNNNNNNN NNNNNNNNNN NNNNNNNNNN NNNNNNNNNN NNNNNNNNNN
89501 NNNNNNNNNN NNNNNNNNNN NNNNNNNNNN NNNNNNNNNN NNNNNNNNNN
89551 NNNNNNNNNN NNNNNNNNNN NNNNNNNNNN NNNNNNNNNN NNNNNNNNNN
89601 NNNNNNNNNN NNNNNNNNNN NNNNNNNNNN NNNNNNNNNN NNNNNNNNNN
89651 NNNNNNNNNN NNNNNNNNNN NNNNNNNNNN NNNNNNNNNN NNNNNNNNNN
89701 NNNNNNNNNN NNNNNNNNNN NNNNNNNNNN NNNNNNNNNN NNNNNNNNNN
89751 NNNNNNNNNN NNNNNNNNNN NNNNNNNNNN NNNNNNNNNN NNNNNNNNNN
89801 NNNNNNNNNN NNNNNNNNNN NNNNNNNNNN NNNNNNNNNN NNNNNNNNNN
89851 NNNNNNNNNN NNNNNNNNNN NNNNNNNNNN NNNNNNNNNN NNNNNNNNNN
89901 NNNNNNNNNN NNNNNNNNNN NNNNNNNNNN NNNNNNNNNN NNNNNNNNNN
89951 NNNNNNNNNN NNNNNNNNNN NNNNNNNNNN NNNNNNNNNN NNNNNNNNNN
90001 NNNNNNNNNN NNNNNNNNNN NNNNNNNNNN NNNNNNNNNN NNNNNNNNNN
90051 NNNNNNNNNN NNNNNNNNNN NNNNNNNNNN NNNNNNNNNN NNNNNNNNNN
90101 NNNNNNNNNN NNNNNNNNNN NNNNNNNNNN NNNNNNNNNN NNNNNNNNNN
90151 NNNNNNNNNN NNNNNNNNNN NNNNNNNNNN NNNNNNNNNN NNNNNNNNNN
90201 NNNNNNNNNN NNNNNNNNNN NNNNNNNNNN NNNNNNNNNN NNNNNNNNNN
90251 NNNNNNNNNN NNNNNNNNNN NNNNNNNNNN NNNNNNNNNN NNNNNNNNNN
90301 NNNNNNNNNN NNNNNNNNNN NNNNNNNNNN NNNNNNNNNN NNNNNNNNNN
90351 NNNNNNNNNN NNNNNNNNNN NNNNNNNNNN NNNNNNNNNN NNNNNNNNNN
90401 NNNNNNNNNN NNNNNNNNNN NNNNNNNNNN NNNNNNNNNN NNNNNNNNNN
90451 NNNNNNNNNN NNNNNNNNNN NNNNNNNNNN NNNNNNNNNN NNNNNNNNNN
90501 NNNNNNNNNN NNNNNNNNNN NNNNNNNNNN NNNNNNNNNN NNNNNNNNNN
90551 NNNNNNNNNN NNNNNNNNNN NNNNNNNNNN NNNNNNNNNN NNNNNNNNNN
90601 NNNNNNNNNN NNNNNNNNNN NNNNNNNNNN NNNNNNNNNN NNNNNNNNNN
90651 NNNNNNNNNN NNNNNNNNNN NNNNNNNNNN NNNNNNNNNN NNNNNNNNNN
90701 NNNNNNNNNN NNNNNNNNNN NNNNNNNNNN NNNNNNNNNN NNNNNNNNNN
90751 NNNNNNNNNN NNNNNNNNNN NNNNNNNNNN NNNNNNNNNN NNNNNNNNNN
90801 NNNNNNNNNN NNNNNNNNNN NNNNNNNNNN NNNNNNNNNN NNNNNNNNNN
90851 NNNNNNNNNN NNNNNNNNNN NNNNNNNNNN NNNNNNNNNN NNNNNNNNNN
90901 NNNNNNNNNN NNNNNNNNNN NNNNNNNNNN NNNNNNNNNN NNNNNNNNNN
90951 NNNNNNNNNN NNNNNNNNNN NNNNNNNNNN NNNNNNNNNN NNNNNNNNNN
91001 NNNNNNNNNN NNNNNNNNNN NNNNNNNNNN NNNNNNNNNN NNNNNNNNNN
91051 NNNNNNNNNN NNNNNNNNNN NNNNNNNNNN NNNNNNNNNN NNNNNNNNNN
91101 NNNNNNNNNN NNNNNNNNNN NNNNNNNNNN NNNNNNNNNN NNNNNNNNNN
91151 NNNNNNNNNN NNNNNNNNNN NNNNNNNNNN NNNNNNNNNN NNNNNNNNNN
91201 NNNNNNNNNN NNNNNNNNNN NNNNNNNNNN NNNNNNNNNN NNNNNNNNNN
91251 NNNNNNNNNN NNNNNNNNNN NNNNNNNNNN NNNNNNNNNN NNNNNNNNNN
91301 NNNNNNNNNN NNNNNNNNNN NNNNNNNNNN NNNNNNNNNN NNNNNNNNNN
91351 NNNNNNNNNN NNNNNNNNNN NNNNNNNNNN NNNNNNNNNN NNNNNNNNNN
91401 NNNNNNNNNN NNNNNNNNNN NNNNNNNNNN NNNNNNNNNN NNNNNNNNNN
91451 NNNNNNNNNN NNNNNNNNNN NNNNNNNNNN NNNNNNNNNN NNNNNNNNNN
91501 NNNNNNNNNN NNNNNNNNNN NNNNNNNNNN NNNNNNNNNN NNNNNNNNNN
91551 NNNNNNNNNN NNNNNNNNNN NNNNNNNNNN NNNNNNNNNN NNNNNNNNNN
91601 NNNNNNNNNN NNNNNNNNNN NNNNNNNNNN NNNNNNNNNN NNNNNNNNNN
91651 NNNNNNNNNN NNNNNNNNNN NNNNNNNNNN NNNNNNNNNN NNNNNNNNNN
91701 NNNNNNNNNN NNNNNNNNNN NNNNNNNNNN NNNNNNNNNN NNNNNNNNNN
91751 NNNNNNNNNN NNNNNNNNNN NNNNNNNNNN NNNNNNNNNN NNNNNNNNNN

FIGURE 3AA

91801 NNNNNNNNNN NNNNNNNNNN NNNNNNNNNN NNNNNNNNNN NNNNNNNNNN
91851 NNNNNNNNNN NNNNNNNNNN NNNNNNNNNN NNNNNNNNNN NNNNNNNNNN
91901 NNNNNNNNNN NNNNNNNNNN NNNNNNNNNN NNNNNNNNNN NNNNNNNNNN
91951 NNNNNNNNNN NNNNNNNNNN NNNNNNNNNN NNNNNNNNNN NNNNNNNNNN
92001 NNNNNNNNNN NNNNNNNNNN NNNNNNNNNN NNNNNNNNNN NNNNNNNNNN
92051 NNNNNNNNNN NNNNNNNNNN NNNNNNNNNN NNNNNNNNNN NNNNNNNNNN
92101 NNNNNNNNNN NNNNNNNNNN NNNNNNNNNN NNNNNNNNNN NNNNNNNNNN
92151 NNNNNNNNNN NNNNNNNNNN NNNNNNNNNN NNNNNNNNNN NNNNNNNNNN
92201 NNNNNNNNNN NNNNNNNNNN NNNNNNNNNN NNNNNNNNNN NNNNNNNNNN
92251 NNNNNNNNNN NNNNNNNNNN NNNNNNNNNN NNNNNNNNNN NNNNNNNNNN
92301 NNNNNNNNNN NNNNNNNNNN NNNNNNNNNN NNNNNNNNNN NNNNNNNNNN
92351 NNNNNNNNNN NNNNNNNNNN NNNNNNNNNN NNNNNNNNNN NNNNNNNNNN
92401 NNNNNNNNNN NNNNNNNNNN NNNNNNNNNN NNNNNNNNNN NNNNNNNNNN
92451 NNNNNNNNNN NNNNNNNNNN NNNNNNNNNN NNNNNNNNNN NNNNNNNNNN
92501 NNNNNNNNNN NNNNNNNNNN NNNNNNNNNN NNNNNNNNNN NNNNNNNNNN
92551 NNNNNNNNNN NNNNNNNNNN NNNNNNNNNN NNNNNNNNNN NNNNNNNNNN
92601 NNNNNNNNNN NNNNNNNNNN NNNNNNNNNN NNNNNNNNNN NNNNNNNNNN
92651 NNNNNNNNNN NNNNNNNNNN NNNNNNNNNN NNNNNNNNNN NNNNNNNNNN
92701 NNNNNNNNNN NNNNNNNNNN NNNNNNNNNN NNNNNNNNNN NNNNNNNNNN
92751 NNNNNNNNNN NNNNNNNNNN NNNNNNNNNN NNNNNNNNNN NNNNNNNNNN
92801 NNNNNNNNNN NNNNNNNNNN NNNNNNNNNN NNNNNNNNNN NNNNNNNNNN
92851 NNNNNNNNNN NNNNNNNNNN NNNNNNNNNN NNNNNNNNNN NNNNNNNNNN
92901 NNNNNNNNNN NNNNNNNNNN NNNNNNNNNN NNNNNNNNNN NNNNNNNNNN
92951 NNNNNNNNNN NNNNNNNNNN NNNNNNNNNN NNNNNNNNNN NNNNNNNNNN
93001 NNNNNNNNNN NNNNNNNNNN NNNNNNNNNN NNNNNNNNNN NNNNNNNNNN
93051 NNNNNNNNNN NNNNNNNNNN NNNNNNNNNN NNNNNNNNNN NNNNNNNNNN
93101 NNNNNNNNNN NNNNNNNNNN NNNNNNNNNN NNNNNNNNNN NNNNNNNNNN
93151 NNNNNNNNNN NNNNNNNNNN NNNNNNNNNN NNNNNNNNNN NNNNNNNNNN
93201 NNNNNNNNNN NNNNNNNNNN NNNNNNNNNN NNNNNNNNNN NNNNNNNNNN
93251 NNNNNNNNNN NNNNNNNNNN NNNNNNNNNN NNNNNNNNNN NNNNNNNNNN
93301 NNNNNNNNNN NNNNNNNNNN NNNNNNNNNN NNNNNNNNNN NNNNNNNNNN
93351 NNNNNNNNNN NNNNNNNNNN NNNNNNNNNN NNNNNNNNNN NNNNNNNNNN
93401 NNNNNNNNNN NNNNNNNNNN NNNNNNNNNN NNNNNNNNNN NNNNNNNNNN
93451 NNNNNNNNNN NNNNNNNNNN NNNNNNNNNN NNNNNNNNNN NNNNNNNNNN
93501 NNNNNNNNNN NNNNNNNNNN NNNNNNNNNN NNNNNNNNNN NNNNNNNNNN
93551 NNNNNNNNNN NNNNNNNNNN NNNNNNNNNN NNNNNNNNNN NNNNNNNNNN
93601 NNNNNNNNNN NNNNNNNNNN NNNNNNNNNN NNNNNNNNNN NNNNNNNNNN
93651 NNNNNNNNNN NNNNNNNNNN NNNNNNNNNN NNNNNNNNNN NNNNNNNNNN
93701 NNNNNNNNNN NNNNNNNNNN NNNNNNNNNN NNNNNNNNNN NNNNNNNNNN
93751 NNNNNNNNNN NNNNNNNNNN NNNNNNNNNN NNNNNNNNNN NNNNNNNNNN
93801 NNNNNNNNNN NNNNNNNNNN NNNNNNNNNN NNNNNNNNNN NNNNNNNNNN
93851 NNNNNNNNNN NNNNNNNNNN NNNNNNNNNN NNNNNNNNNN NNNNNNNNNN
93901 NNNNNNNNNN NNNNNNNNNN NNNNNNNNNN NNNNNNNNNN NNNNNNNNNN
93951 NNNNNNNNNN NNNNNNNNNN NNNNNNNNNN NNNNNNNNNN NNNNNNNNNN
94001 NNNNNNNNNN NNNNNNNNNN NNNNNNNNNN NNNNNNNNNN NNNNNNNNNN
94051 NNNNNNNNNN NNNNNNNNNN NNNNNNNNNN NNNNNNNNNN NNNNNNNNNN
94101 NNNNNNNNNN NNNNNNNNNN NNNNNNNNNN NNNNNNNNNN NNNNNNNNNN
94151 NNNNNNNNNN NNNNNNNNNN NNNNNNNNNN NNNNNNNNNN NNNNNNNNNN
94201 NNNNNNNNNN NNNNNNNNNN NNNNNNNNNN NNNNNNNNNN NNNNNNNNNN
94251 NNNNNNNNNN NNNNNNNNNN NNNNNNNNNN NNNNNNNNNN NNNNNNNNNN
94301 NNNNNNNNNN NNNNNNNNNN NNNNNNNNNN NNNNNNNNNN NNNNNNNNNN
94351 NNNNNNNNNN NNNNNNNNNN NNNNNNNNNN NNNNNNNNNN NNNNNNNNNN
94401 NNNNNNNNNN NNNNNNNNNN NNNNNNNNNN NNNNNNNNNN NNNNNNNNNN
94451 NNNNNNNNNN NNNNNNNNNN NNNNNNNNNN NNNNNNNNNN NNNNNNNNNN
94501 NNNNNNNNNN NNNNNNNNNN NNNNNNNNNN NNNNNNNNNN NNNNNNNNNN
94551 NNNNNNNNNN NNNNNNNNNN NNNNNNNNNN NNNNNNNNNN NNNNNNNNNN
94601 NNNNNNNNNN NNNNNNNNNN NNNNNNNNNN NNNNNNNNNN NNNNNNNNNN
94651 NNNNNNNNNN NNNNNNNNNN NNNNNNNNNN NNNNNNNNNN NNNNNNNNNN
94701 NNNNNNNNNN NNNNNNNNNN NNNNNNNNNN NNNNNNNNNN NNNNNNNNNN
94751 NNNNNNNNNN NNNNNNNNNN NNNNNNNNNN NNNNNNNNNN NNNNNNNNNN
94801 NNNNNNNNNN NNNNNNNNNN NNNNNNNNNN NNNNNNNNNN NNNNNNNNNN
94851 NNNNNNNNNN NNNNNNNNNN NNNNNNNNNN NNNNNNNNNN NNNNNNNNNN
94901 NNNNNNNNNN NNNNNNNNNN NNNNNNNNNN NNNNNNNNNN NNNNNNNNNN
94951 NNNNNNNNNN NNNNNNNNNN NNNNNNNNNN NNNNNNNNNN NNNNNNNNNN
95001 NNNNNNNNNN NNNNNNNNNN NNNNNNNNNN NNNNNNNNNN NNNNNNNNNN
95051 NNNNNNNNNN NNNNNNNNNN NNNNNNNNNN NNNNNNNNNN NNNNNNNNNN
95101 NNNNNNNNNN NNNNNNNNNN NNNNNNNNNN NNNNNNNNNN NNNNNNNNNN
95151 NNNNNNNNNN NNNNNNNNNN NNNNNNNNNN NNNNNNNNNN NNNNNNNNNN

FIGURE 3BB

95201 NNNNNNNNNN NNNNNNNNNN NNNNNNNNNN NNNNNNNNNN NNNNNNNNNN
95251 NNNNNNNNNN NNNNNNNNNN NNNNNNNNNN NNNNNNNNNN NNNNNNNNNN
95301 NNNNNNNNNN NNNNNNNNNN NNNNNNNNNN NNNNNNNNNN NNNNNNNNNN
95351 NNNNNNNNNN NNNNNNNNNN NNNNNNNNNN NNNNNNNNNN NNNNNNNNNN
95401 NNNNNNNNNN NNNNNNNNNN NNNNNNNNNN NNNNNNNNNN NNNNNNNNNN
95451 NNNNNNNNNN NNNNNNNNNN NNNNNNNNNN NNNNNNNNNN NNNNNNNNNN
95501 NNNNNNNNNN NNNNNNNNNN NNNNNNNNNN NNNNNNNNNN NNNNNNNNNN
95551 NNNNNNNNNN NNNNNNNNNN NNNNNNNNNN NNNNNNNNNN NNNNNNNNNN
95601 NNNNNNNNNN NNNNNNNNNN NNNNNNNNNN NNNNNNNNNN NNNNNNNNNN
95651 NNNNNNNNNN NNNNNNNNNN NNNNNNNNNN NNNNNNNNNN NNNNNNNNNN
95701 NNNNNNNNNN NNNNNNNNNN NNNNNNNNNN NNNNNNNNNN NNNNNNNNNN
95751 NNNNNNNNNN NNNNNNNNNN NNNNNNNNNN NNNNNNNNNN NNNNNNNNNN
95801 NNNNNNNNNN NNNNNNNNNN NNNNNNNNNN NNNNNNNNNN NNNNNNNNNN
95851 NNNNNNNNNN NNNNNNNNNN NNNNNNNNNN NNNNNNNNNN NNNNNNNNNN
95901 NNNNNNNNNN NNNNNNNNNN NNNNNNNNNN NNNNNNNNNN NNNNNNNNNN
95951 NNNNNNNNNN NNNNNNNNNN NNNNNNNNNN NNNNNNNNNN NNNNNNNNNN
96001 NNNNNNNNNN NNNNNNNNNN NNNNNNNNNN NNNNNNNNNN NNNNNNNNNN
96051 NNNNNNNNNN NNNNNNNNNN NNNNNNNNNN NNNNNNNNNN NNNNNNNNNN
96101 NNNNNNNNNN NNNNNNNNNN NNNNNNNNNN NNNNNNNNNN NNNNNNNNNN
96151 NNNNNNNNNN NNNNNNNNNN NNNNNNNNNN NNNNNNNNNN NNNNNNNNNN
96201 NNNNNNNNNN NNNNNNNNNN NNNNNNNNNN NNNNNNNNNN NNNNNNNNNN
96251 NNNNNNNNNN NNNNNNNNNN NNNNNNNNNN NNNNNNNNNN NNNNNNNNNN
96301 NNNNNNNNNN NNNNNNNNNN NNNNNNNNNN NNNNNNNNNN NNNNNNNNNN
96351 NNNNNNNNNN NNNNNNNNNN NNNNNNNNNN NNNNNNNNNN NNNNNNNNNN
96401 NNNNNNNNNN NNNNNNNNNN NNNNNNNNNN NNNNNNNNNN NNNNNNNNNN
96451 NNNNNNNNNN NNNNNNNNNN NNNNNNNNNN NNNNNNNNNN NNNNNNNNNN
96501 NNNNNNNNNN NNNNNNNNNN NNNNNNNNNN NNNNNNNNNN NNNNNNNNNN
96551 NNNNNNNNNN NNNNNNNNNN NNNNNNNNNN NNNNNNNNNN NNNNNNNNNN
96601 NNNNNNNNNN NNNNNNNNNN NNNNNNNNNN NNNNNNNNNN NNNNNNNNNN
96651 NNNNNNNNNN NNNNNNNNNN NNNNNNNNNN NNNNNNNNNN NNNNNNNNNN
96701 NNNNNNNNNN NNNNNNNNNN NNNNNNNNNN NNNNNNNNNN NNNNNNNNNN
96751 NNNNNNNNNN NNNNNNNNNN NNNNNNNNNN NNNNNNNNNN NNNNNNNNNN
96801 NNNNNNNNNN NNNNNNNNNN NNNNNNNNNN NNNNNNNNNN NNNNNNNNNN
96851 NNNNNNNNNN NNNNNNNNNN NNNNNNNNNN NNNNNNNNNN NNNNNNNNNN
96901 NNNNNNNNNN NNNNNNNNNN NNNNNNNNNN NNNNNNNNNN NNNNNNNNNN
96951 NNNNNNNNNN NNNNNNNNNN NNNNNNNNNN NNNNNNNNNN NNNNNNNNNN
97001 NNNNNNNNNN NNNNNNNNNN NNNNNNNNNN NNNNNNNNNN NNNNNNNNNN
97051 NNNNNNNNNN NNNNNNNNNN NNNNNNNNNN NNNNNNNNNN NNNNNNNNNN
97101 NNNNNNNNNN NNNNNNNNNN NNNNNNNNNN NNNNNNNNNN NNNNNNNNNN
97151 NNNNNNNNNN NNNNNNNNNN NNNNNNNNNN NNNNNNNNNN NNNNNNNNNN
97201 NNNNNNNNNN NNNNNNNNNN NNNNNNNNNN NNNNNNNNNN NNNNNNNNNN
97251 NNNNNNNNNN NNNNNNNNNN NNNNNNNNNN NNNNNNNNNN NNNNNNNNNN
97301 NNNNNNNNNN NNNNNNNNNN NNNNNNNNNN NNNNNNNNNN NNNNNNNNNN
97351 NNNNNNNNNN NNNNNNNNNN NNNNNNNNNN NNNNNNNNNN NNNNNNNNNN
97401 NNNNNNNNNN NNNNNNNNNN NNNNNNNNNN NNNNNNNNNN NNNNNNNNNN
97451 NNNNNNNNNN NNNNNNNNNN NNNNNNNNNN NNNNNNNNNN NNNNNNNNNN
97501 NNNNNNNNNN NNNNNNNNNN NNNNNNNNNN NNNNNNNNNN NNNNNNNNNN
97551 NNNNNNNNNN NNNNNNNNNN NNNNNNNNNN NNNNNNNNNN NNNNNNNNNN
97601 NNNNNNNNNN NNNNNNNNNN NNNNNNNNNN NNNNNNNNNN NNNNNNNNNN
97651 NNNNNNNNNN NNNNNNNNNN NNNNNNNNNN NNNNNNNNNN NNNNNNNNNN
97701 NNNNNNNNNN NNNNNNNNNN NNNNNNNNNN NNNNNNNNNN NNNNNNNNNN
97751 NNNNNNNNNN NNNNNNNNNN NNNNNNNNNN NNNNNNNNNN NNNNNNNNNN
97801 NNNNNNNNNN NNNNNNNNNN NNNNNNNNNN NNNNNNNNNN NNNNNNNNNN
97851 NNNNNNNNNN NNNNNNNNNN NNNNNNNNNN NNNNNNNNNN NNNNNNNNNN
97901 NNNNNNNNNN NNNNNNNNNN NNNNNNNNNN NNNNNNNNNN NNNNNNNNNN
97951 NNNNNNNNNN NNNNNNNNNN NNNNNNNNNN NNNNNNNNNN NNNNNNNNNN
98001 NNNNNNNNNN NNNNNNNNNN NNNNNNNNNN NNNNNNNNNN NNNNNNNNNN
98051 NNNNNNNNNN NNNNNNNNNN NNNNNNNNNN NNNNNNNNNN NNNNNNNNNN
98101 NNNNNNNNNN NNNNNNNNNN NNNNNNNNNN NNNNNNNNNN NNNNNNNNNN
98151 NNNNNNNNNN NNNNNNNNNN NNNNNNNNNN NNNNNNNNNN NNNNNNNNNN
98201 NNNNNNNNNN NNNNNNNNNN NNNNNNNNNN NNNNNNNNNN NNNNNNNNNN
98251 NNNNNNNNNN NNNNNNNNNN NNNNNNNNNN NNNNNNNNNN NNNNNNNNNN
98301 NNNNNNNNNN NNNNNNNNNN NNNNNNNNNN NNNNNNNNNN NNNNNNNNNN
98351 NNNNNNNNNN NNNNNNNNNN NNNNNNNNNN NNNNNNNNNN NNNNNNNNNN
98401 NNNNNNNNNN NNNNNNNNNN NNNNNNNNNN NNNNNNNNNN NNNNNNNNNN
98451 NNNNNNNNNN NNNNNNNNNN NNNNNNNNNN NNNNNNNNNN NNNNNNNNNN
98501 NNNNNNNNNN NNNNNNNNNN NNNNNNNNNN NNNNNNNNNN NNNNNNNNNN
98551 NNNNNNNNNN NNNNNNNNNN NNNNNNNNNN NNNNNNNNNN NNNNNNNNNN

FIGURE 3CC

98601 NNNNNNNNNN NNNNNNNNNN NNNNNNNNNN NNNNNNNNNN NNNNNNNNNN
98651 NNNNNNNNNN NNNNNNNNNN NNNNNNNNNN NNNNNNNNNN NNNNNNNNNN
98701 NNNNNNNNNN NNNNNNNNNN NNNNNNNNNN NNNNNNNNNN NNNNNNNNNN
98751 NNNNNNNNNN NNNNNNNNNN NNNNNNNNNN NNNNNNNNNN NNNNNNNNNN
98801 NNNNNNNNNN NNNNNNNNNN NNNNNNNNNN NNNNNNNNNN NNNNNNNNNN
98851 NNNNNNNNNN NNNNNNNNNN NNNNNNNNNN NNNNNNNNNN NNNNNNNNNN
98901 NNNNNNNNNN NNNNNNNNNN NNNNNNNNNN NNNNNNNNNN NNNNNNNNNN
98951 NNNNNNNNNN NNNNNNNNNN NNNNNNNNNN NNNNNNNNNN NNNNNNNNNN
99001 NNNNNNNNNN NNNNNNNNNN NNNNNNNNNN NNNNNNNNNN NNNNNNNNNN
99051 NNNNNNNNNN NNNNNNNNNN NNNNNNNNNN NNNNNNNNNN NNNNNNNNNN
99101 NNNNNNNNNN NNNNNNNNNN NNNNNNNNNN NNNNNNNNNN NNNNNNNNNN
99151 NNNNNNNNNN NNNNNNNNNN NNNNNNNNNN NNNNNNNNNN NNNNNNNNNN
99201 NNNNNNNNNN NNNNNNNNNN NNNNNNNNNN NNNNNNNNNN NNNNNNNNNN
99251 NNNNNNNNNN NNNNNNNNNN NNNNNNNNNN NNNNNNNNNN NNNNNNNNNN
99301 NNNNNNNNNN NNNNNNNNNN NNNNNNNNNN NNNNNNNNNN NNNNNNNNNN
99351 NNNNNNNNNN NNNNNNNNNN NNNNNNNNNN NNNNNNNNNN NNNNNNNNNN
99401 NNNNNNNNNN NNNNNNNNNN NNNNNNNNNN NNNNNNNNNN NNNNNNNNNN
99451 NNNNNNNNNN NNNNNNNNNN NNNNNNNNNN NNNNNNNNNN NNNNNNNNNN
99501 NNNNNNNNNN NNNNNNNNNN NNNNNNNNNN NNNNNNNNNN NNNNNNNNNN
99551 NNNNNNNNNN NNNNNNNNNN NNNNNNNNNN NNNNNNNNNN NNNNNNNNNN
99601 NNNNNNNNNN NNNNNNNNNN NNNNNNNNNN NNNNNNNNNN NNNNNNNNNN
99651 NNNNNNNNNN NNNNNNNNNN NNNNNNNNNN NNNNNNNNNN NNNNNNNNNN
99701 NNNNNNNNNN NNNNNNNNNN NNNNNNNNNN NNNNNNNNNN NNNNNNNNNN
99751 NNNNNNNNNN NNNNNNNNNN NNNNNNNNNN NNNNNNNNNN NNNNNNNNNN
99801 NNNNNNNNNN NNNNNNNNNN NNNNNNNNNN NNNNNNNNNN NNNNNNNNNN
99851 NNNNNNNNNN NNNNNNNNNN NNNNNNNNNN NNNNNNNNNN NNNNNNNNNN
99901 NNNNNNNNNN NNNNNNNNNN NNNNNNNNNN NNNNNNNNNN NNNNNNNNNN
99951 NNNNNNNNNN NNNNNNNNNN NNNNNNNNNN NNNNNNNNNN NNNNNNNNNN
100001 NNNNNNNNNN NNNNNNNNNN NNNNNNNNNN NNNNNNNNNN NNNNNNNNNN
100051 NNNNNNNNNN NNNNNNNNNN NNNNNNNNNN NNNNNNNNNN NNNNNNNNNN
100101 NNNNNNNNNN NNNNNNNNNN NNNNNNNNNN NNNNNNNNNN NNNNNNNNNN
100151 NNNNNNNNNN NNNNNNNNNN NNNNNNNNNN NNNNNNNNNN NNNNNNNNNN
100201 NNNNNNNNNN NNNNNNNNNN NNNNNNNNNN NNNNNNNNNN NNNNNNNNNN
100251 NNNNNNNNNN NNNNNNNNNN NNNNNNNNNN NNNNNNNNNN NNNNNNNNNN
100301 NNNNNNNNNN NNNNNNNNNN NNNNNNNNNN NNNNNNNNNN NNNNNNNNNN
100351 NNNNNNNNNN NNNNNNNNNN NNNNNNNNNN NNNNNNNNNN NNNNNNNNNN
100401 NNNNNNNNNN NNNNNNNNNN NNNNNNNNNN NNNNNNNNNN NNNNNNNNNN
100451 NNNNNNNNNN NNNNNNNNNN NNNNNNNNNN NNNNNNNNNN NNNNNNNNNN
100501 NNNNNNNNNN NNNNNNNNNN NNNNNNNNNN NNNNNNNNNN NNNNNNNNNN
100551 NNNNNNNNNN NNNNNNNNNN NNNNNNNNNN NNNNNNNNNN NNNNNNNNNN
100601 NNNNNNNNNN NNNNNNNNNN NNNNNNNNNN NNNNNNNNNN NNNNNNNNNN
100651 NNNNNNNNNN NNNNNNNNNN NNNNNNNNNN NNNNNNNNNN NNNNNNNNNN
100701 NNNNNNNNNN NNNNNNNNNN NNNNNNNNNN NNNNNNNNNN NNNNNNNNNN
100751 NNNNNNNNNN NNNNNNNNNN NNNNNNNNNN NNNNNNNNNN NNNNNNNNNN
100801 NNNNNNNNNN NNNNNNNNNN NNNNNNNNNN NNNNNNNNNN NNNNNNNNNN
100851 NNNNNNNNNN NNNNNNNNNN NNNNNNNNNN NNNNNNNNNN NNNNNNNNNN
100901 NNNNNNNNNN NNNNNNNNNN NNNNNNNNNN NNNNNNNNNN NNNNNNNNNN
100951 NNNNNNNNNN NNNNNNNNNN NNNNNNNNNN NNNNNNNNNN NNNNNNNNNN
101001 NNNNNNNNNN NNNNNNNNNN NNNNNNNNNN NNNNNNNNNN NNNNNNNNNN
101051 NNNNNNNNNN NNNNNNNNNN NNNNNNNNNN NNNNNNNNNN NNNNNNNNNN
101101 NNNNNNNNNN NNNNNNNNNN NNNNNNNNNN NNNNNNNNNN NNNNNNNNNN
101151 NNNNNNNNNN NNNNNNNNNN NNNNNNNNNN NNNNNNNNNN NNNNNNNNNN
101201 NNNNNNNNNN NNNNNNNNNN NNNNNNNNNN NNNNNNNNNN NNNNNNNNNN
101251 NNNNNNNNNN NNNNNNNNNN NNNNNNNNNN NNNNNNNNNN NNNNNNNNNN
101301 NNNNNNNNNN NNNNNNNNNN NNNNNNNNNN NNNNNNNNNN NNNNNNNNNN
101351 NNNNNNNNNN NNNNNNNNNN NNNNNNNNNN NNNNNNNNNN NNNNNNNNNN
101401 NNNNNNNNNN NNNNNNNNNN NNNNNNNNNN NNNNNNNNNN NNNNNNNNNN
101451 NNNNNNNNNN NNNNNNNNNN NNNNNNNNNN NNNNNNNNNN NNNNNNNNNN
101501 NNNNNNNNNN NNNNNNNNNN NNNNNNNNNN NNNNNNNNNN NNNNNNNNNN
101551 NNNNNNNNNN NNNNNNNNNN NNNNNNNNNN NNNNNNNNNN NNNNNNNNNN
101601 NNNNNNNNNN NNNNNNNNNN NNNNNNNNNN NNNNNNNNNN NNNNNNNNNN
101651 NNNNNNNNNN NNNNNNNNNN NNNNNNNNNN NNNNNNNNNN NNNNNNNNNN
101701 NNNNNNNNNN NNNNNNNNNN NNNNNNNNNN NNNNNNNNNN NNNNNNNNNN
101751 NNNNNNNNNN NNNNNNNNNN NNNNNNNNNN NNNNNNNNNN NNNNNNNNNN
101801 NNNNNNNNNN NNNNNNNNNN NNNNNNNNNN NNNNNNNNNN NNNNNNNNNN
101851 NNNNNNNNNN NNNNNNNNNN NNNNNNNNNN NNNNNNNNNN NNNNNNNNNN
101901 NNNNNNNNNN NNNNNNNNNN NNNNNNNNNN NNNNNNNNNN NNNNNNNNNN
101951 NNNNNNNNNN NNNNNNNNNN NNNNNNNNNN NNNNNNNNNN NNNNNNNNNN

FIGURE 3DD

102001 NNNNNNNNNN NNNNNNNNNN NNNNNNNNNN NNNNNNNNNN NNNNNNNNNN
102051 NNNNNNNNNN NNNNNNNNNN NNNNNNNNNN NNNNNNNNNN NNNNNNNNNN
102101 NNNNNNNNNN NNNNNNNNNN NNNNNNNNNN NNNNNNNNNN NNNNNNNNNN
102151 NNNNNNNNNN NNNNNNNNNN NNNNNNNNNN NNNNNNNNNN NNNNNNNNNN
102201 NNNNNNNNNN NNNNNNNNNN NNNNNNNNNN NNNNNNNNNN NNNNNNNNNN
102251 NNNNNNNNNN NNNNNNNNNN NNNNNNNNNN NNNNNNNNNN NNNNNNNNNN
102301 NNNNNNNNNN NNNNNNNNNN NNNNNNNNNN NNNNNNNNNN NNNNNNNNNN
102351 NNNNNNNNNN NNNNNNNNNN NNNNNNNNNN NNNNNNNNNN NNNNNNNNNN
102401 NNNNNNNNNN NNNNNNNNNN NNNNNNNNNN NNNNNNNNNN NNNNNNNNNN
102451 NNNNNNNNNN NNNNNNNNNN NNNNNNNNNN NNNNNNNNNN NNNNNNNNNN
102501 NNNNNNNNNN NNNNNNNNNN NNNNNNNNNN NNNNNNNNNN NNNNNNNNNN
102551 NNNNNNNNNN NNNNNNNNNN NNNNNNNNNN NNNNNNNNNN NNNNNNNNNN
102601 NNNNNNNNNN NNNNNNNNNN NNNNNNNNNN NNNNNNNNNN NNNNNNNNNN
102651 NNNNNNNNNN NNNNNNNNNN NNNNNNNNNN NNNNNNNNNN NNNNNNNNNN
102701 NNNNNNNNNN NNNNNNNNNN NNNNNNNNNN NNNNNNNNNN NNNNNNNNNN
102751 NNNNNNNNNN NNNNNNNNNN NNNNNNNNNN NNNNNNNNNN NNNNNNNNNN
102801 NNNNNNNNNN NNNNNNNNNN NNNNNNNNNN NNNNNNNNNN NNNNNNNNNN
102851 NNNNNNNNNN NNNNNNNNNN NNNNNNNNNN NNNNNNNNNN NNNNNNNNNN
102901 NNNNNNNNNN NNNNNNNNNN NNNNNNNNNN NNNNNNNNNN NNNNNNNNNN
102951 NNNNNNNNNN NNNNNNNNNN NNNNNNNNNN NNNNNNNNNN NNNNNNNNNN
103001 NNNNNNNNNN NNNNNNNNNN NNNNNNNNNN NNNNNNNNNN NNNNNNNNNN
103051 NNNNNNNNNN NNNNNNNNNN NNNNNNNNNN NNNNNNNNNN NNNNNNNNNN
103101 NNNNNNNNNN NNNNNNNNNN NNNNNNNNNN NNNNNNNNNN NNNNNNNNNN
103151 NNNNNNNNNN NNNNNNNNNN NNNNNNNNNN NNNNNNNNNN NNNNNNNNNN
103201 NNNNNNNNNN NNNNNNNNNN NNNNNNNNNN NNNNNNNNNN NNNNNNNNNN
103251 NNNNNNNNNN NNNNNNNNNN NNNNNNNNNN NNNNNNNNNN NNNNNNNNNN
103301 NNNNNNNNNN NNNNNNNNNN NNNNNNNNNN NNNNNNNNNN NNNNNNNNNN
103351 NNNNNNNNNN NNNNNNNNNN NNNNNNNNNN NNNNNNNNNN NNNNNNNNNN
103401 NNNNNNNNNN NNNNNNNNNN NNNNNNNNNN NNNNNNNNNN NNNNNNNNNN
103451 NNNNNNNNNN NNNNNNNNNN NNNNNNNNNN NNNNNNNNNN NNNNNNNNNN
103501 NNNNNNNNNN NNNNNNNNNN NNNNNNNNNN NNNNNNNNNN NNNNNNNNNN
103551 NNNNNNNNNN NNNNNNNNNN NNNNNNNNNN NNNNNNNNNN NNNNNNNNNN
103601 NNNNNNNNNN NNNNNNNNNN NNNNNNNNNN NNNNNNNNNN NNNNNNNNNN
103651 NNNNNNNNNN NNNNNNNNNN NNNNNNNNNN NNNNNNNNNN NNNNNNNNNN
103701 NNNNNNNNNN NNNNNNNNNN NNNNNNNNNN NNNNNNNNNN NNNNNNNNNN
103751 NNNNNNNNNN NNNNNNNNNN NNNNNNNNNN NNNNNNNNNN NNNNNNNNNN
103801 NNNNNNNNNN NNNNNNNNNN NNNNNNNNNN NNNNNNNNNN NNNNNNNNNN
103851 NNNNNNNNNN NNNNNNNNNN NNNNNNNNNN NNNNNNNNNN NNNNNNNNNN
103901 NNNNNNNNNN NNNNNNNNNN NNNNNNNNNN NNNNNNNNNN NNNNNNNNNN
103951 NNNNNNNNNN NNNNNNNNNN NNNNNNNNNN NNNNNNNNNN NNNNNNNNNN
104001 NNNNNNNNNN NNNNNNNNNN NNNNNNNNNN NNNNNNNNNN NNNNNNNNNN
104051 NNNNNNNNNN NNNNNNNNNN NNNNNNNNNN NNNNNNNNNN NNNNNNNNNN
104101 NNNNNNNNNN NNNNNNNNNN NNNNNNNNNN NNNNNNNNNN NNNNNNNNNN
104151 NNNNNNNNNN NNNNNNNNNN NNNNNNNNNN NNNNNNNNNN NNNNNNNNNN
104201 NNNNNNNNNN NNNNNNNNNN NNNNNNNNNN NNNNNNNNNN NNNNNNNNNN
104251 NNNNNNNNNN NNNNNNNNNN NNNNNNNNNN NNNNNNNNNN NNNNNNNNNN
104301 NNNNNNNNNN NNNNNNNNNN NNNNNNNNNN NNNNNNNNNN NNNNNNNNNN
104351 NNNNNNNNNN NNNNNNNNNN NNNNNNNNNN NNNNNNNNNN NNNNNNNNNN
104401 NNNNNNNNNN NNNNNNNNNN NNNNNNNNNN NNNNNNNNNN NNNNNNNNNN
104451 NNNNNNNNNN NNNNNNNNNN NNNNNNNNNN NNNNNNNNNN NNNNNNNNNN
104501 NNNNNNNNNN NNNNNNNNNN NNNNNNNNNN NNNNNNNNNN NNNNNNNNNN
104551 NNNNNNNNNN NNNNNNNNNN NNNNNNNNNN NNNNNNNNNN NNNNNNNNNN
104601 NNNNNNNNNN NNNNNNNNNN NNNNNNNNNN NNNNNNNNNN NNNNNNNNNN
104651 NNNNNNNNNN NNNNNNNNNN NNNNNNNNNN NNNNNNNNNN NNNNNNNNNN
104701 NNNNNNNNNN NNNNNNNNNN NNNNNNNNNN NNNNNNNNNN NNNNNNNNNN
104751 NNNNNNNNNN NNNNNNNNNN NNNNNNNNNN NNNNNNNNNN NNNNNNNNNN
104801 NNNNNNNNNN NNNNNNNNNN NNNNNNNNNN NNNNNNNNNN NNNNNNNNNN
104851 NNNNNNNNNN NNNNNNNNNN NNNNNNNNNN NNNNNNNNNN NNNNNNNNNN
104901 NNNNNNNNNN NNNNNNNNNN NNNNNNNNNN NNNNNNNNNN NNNNNNNNNN
104951 NNNNNNNNNN NNNNNNNNNN NNNNNNNNNN NNNNNNNNNN NNNNNNNNNN
105001 NNNNNNNNNN NNNNNNNNNN NNNNNNNNNN NNNNNNNNNN NNNNNNNNNN
105051 NNNNNNNNNN NNNNNNNNNN NNNNNNNNNN NNNNNNNNNN NNNNNNNNNN
105101 NNNNNNNNNN NNNNNNNNNN NNNNNNNNNN NNNNNNNNNN NNNNNNNNNN
105151 NNNNNNNNNN NNNNNNNNNN NNNNNNNNNN NNNNNNNNNN NNNNNNNNNN
105201 NNNNNNNNNN NNNNNNNNNN NNNNNNNNNN NNNNNNNNNN NNNNNNNNNN
105251 NNNNNNNNNN NNNNNNNNNN NNNNNNNNNN NNNNNNNNNN NNNNNNNNNN
105301 NNNNNNNNNN NNNNNNNNNN NNNNNNNNNN NNNNNNNNNN NNNNNNNNNN
105351 NNNNNNNNNN NNNNNNNNNN NNNNNNNNNN NNNNNNNNNN NNNNNNNNNN

FIGURE 3EE

105401 NNNNNNNNNN NNNNNNNNNN NNNNNNNNNN NNNNNNNNNN NNNNNNNNNN
105451 NNNNNNNNNN NNNNNNNNNN NNNNNNNNNN NNNNNNNNNN NNNNNNNNNN
105501 NNNNNNNNNN NNNNNNNNNN NNNNNNNNNN NNNNNNNNNN NNNNNNNNNN
105551 NNNNNNNNNN NNNNNNNNNN NNNNNNNNNN NNNNNNNNNN NNNNNNNNNN
105601 NNNNNNNNNN NNNNNNNNNN NNNNNNNNNN NNNNNNNNNN NNNNNNNNNN
105651 NNNNNNNNNN NNNNNNNNNN NNNNNNNNNN NNNNNNNNNN NNNNNNNNNN
105701 NNNNNNNNNN NNNNNNNNNN NNNNNNNNNN NNNNNNNNNN NNNNNNNNNN
105751 NNNNNNNNNN NNNNNNNNNN NNNNNNNNNN NNNNNNNNNN NNNNNNNNNN
105801 NNNNNNNNNN NNNNNNNNNN NNNNNNNNNN NNNNNNNNNN NNNNNNNNNN
105851 NNNNNNNNNN NNNNNNNNNN NNNNNNNNNN NNNNNNNNNN NNNNNNNNNN
105901 NNNNNNNNNN NNNNNNNNNN NNNNNNNNNN NNNNNNNNNN NNNNNNNNNN
105951 NNNNNNNNNN NNNNNNNNNN NNNNNNNNNN NNNNNNNNNN NNNNNNNNNN
106001 NNNNNNNNNN NNNNNNNNNN NNNNNNNNNN NNNNNNNNNN NNNNNNNNNN
106051 NNNNNNNNNN NNNNNNNNNN NNNNNNNNNN NNNNNNNNNN NNNNNNNNNN
106101 NNNNNNNNNN NNNNNNNNNN NNNNNNNNNN NNNNNNNNNN NNNNNNNNNN
106151 NNNNNNNNNN NNNNNNNNNN NNNNNNNNNN NNNNNNNNNN NNNNNNNNNN
106201 NNNNNNNNNN NNNNNNNNNN NNNNNNNNNN NNNNNNNNNN NNNNNNNNNN
106251 NNNNNNNNNN NNNNNNNNNN NNNNNNNNNN NNNNNNNNNN NNNNNNNNNN
106301 NNNNNNNNNN NNNNNNNNNN NNNNNNNNNN NNNNNNNNNN NNNNNNNNNN
106351 NNNNNNNNNN NNNNNNNNNN NNNNNNNNNN NNNNNNNNNN NNNNNNNNNN
106401 NNNNNNNNNN NNNNNNNNNN NNNNNNNNNN NNNNNNNNNN NNNNNNNNNN
106451 NNNNNNNNNN NNNNNNNNNN NNNNNNNNNN NNNNNNNNNN NNNNNNNNNN
106501 NNNNNNNNNN NNNNNNNNNN NNNNNNNNNN NNNNNNNNNN NNNNNNNNNN
106551 NNNNNNNNNN NNNNNNNNNN NNNNNNNNNN NNNNNNNNNN NNNNNNNNNN
106601 NNNNNNNNNN NNNNNNNNNN NNNNNNNNNN NNNNNNNNNN NNNNNNNNNN
106651 NNNNNNNNNN NNNNNNNNNN NNNNNNNNNN NNNNNNNNNN NNNNNNNNNN
106701 NNNNNNNNNN NNNNNNNNNN NNNNNNNNNN NNNNNNNNNN NNNNNNNNNN
106751 NNNNNNNNNN NNNNNNNNNN NNNNNNNNNN NNNNNNNNNN NNNNNNNNNN
106801 NNNNNNNNNN NNNNNNNNNN NNNNNNNNNN NNNNNNNNNN NNNNNNNNNN
106851 NNNNNNNNNN NNNNNNNNNN NNNNNNNNNN NNNNNNNNNN NNNNNNNNNN
106901 NNNNNNNNNN NNNNNNNNNN NNNNNNNNNN NNNNNNNNNN NNNNNNNNNN
106951 NNNNNNNNNN NNNNNNNNNN NNNNNNNNNN NNNNNNNNNN NNNNNNNNNN
107001 NNNNNNNNNN NNNNNNNNNN NNNNNNNNNN NNNNNNNNNN NNNNNNNNNN
107051 NNNNNNNNNN NNNNNNNNNN NNNNNNNNNN NNNNNNNNNN NNNNNNNNNN
107101 NNNNNNNNNN NNNNNNNNNN NNNNNNNNNN NNNNNNNNNN NNNNNNNNNN
107151 NNNNNNNNNN NNNNNNNNNN NNNNNNNNNN NNNNNNNNNN NNNNNNNNNN
107201 NNNNNNNNNN NNNNNNNNNN NNNNNNNNNN NNNNNNNNNN NNNNNNNNNN
107251 NNNNNNNNNN NNNNNNNNNN NNNNNNNNNN NNNNNNNNNN NNNNNNNNNN
107301 NNNNNNNNNN NNNNNNNNNN NNNNNNNNNN NNNNNNNNNN NNNNNNNNNN
107351 NNNNNNNNNN NNNNNNNNNN NNNNNNNNNN NNNNNNNNNN NNNNNNNNNN
107401 NNNNNNNNNN NNNNNNNNNN NNNNNNNNNN NNNNNNNNNN NNNNNNNNNN
107451 NNNNNNNNNN NNNNNNNNNN NNNNNNNNNN NNNNNNNNNN NNNNNNNNNN
107501 NNNNNNNNNN NNNNNNNNNN NNNNNNNNNN NNNNNNNNNN NNNNNNNNNN
107551 NNNNNNNNNN NNNNNNNNNN NNNNNNNNNN NNNNNNNNNN NNNNNNNNNN
107601 NNNNNNNNNN NNNNNNNNNN NNNNNNNNNN NNNNNNNNNN NNNNNNNNNN
107651 NNNNNNNNNN NNNNNNNNNN NNNNNNNNNN NNNNNNNNNN NNNNNNNNNN
107701 NNNNNNNNNN NNNNNNNNNN NNNNNNNNNN NNNNNNNNNN NNNNNNNNNN
107751 NNNNNNNNNN NNNNNNNNNN NNNNNNNNNN NNNNNNNNNN NNNNNNNNNN
107801 NNNNNNNNNN NNNNNNNNNN NNNNNNNNNN NNNNNNNNNN NNNNNNNNNN
107851 NNNNNNNNNN NNNNNNNNNN NNNNNNNNNN NNNNNNNNNN NNNNNNNNNN
107901 NNNNNNNNNN NNNNNNNNNN NNNNNNNNNN NNNNNNNNNN NNNNNNNNNN
107951 NNNNNNNNNN NNNNNNNNNN NNNNNNNNNN NNNNNNNNNN NNNNNNNNNN
108001 NNNNNNNNNN NNNNNNNNNN NNNNNNNNNN NNNNNNNNNN NNNNNNNNNN
108051 NNNNNNNNNN NNNNNNNNNN NNNNNNNNNN NNNNNNNNNN NNNNNNNNNN
108101 NNNNNNNNNN NNNNNNNNNN NNNNNNNNNN NNNNNNNNNN NNNNNNNNNN
108151 NNNNNNNNNN NNNNNNNNNN NNNNNNNNNN NNNNNNNNNN NNNNNNNNNN
108201 NNNNNNNNNN NNNNNNNNNN NNNNNNNNNN NNNNNNNNNN NNNNNNNNNN
108251 NNNNNNNNNN NNNNNNNNNN NNNNNNNNNN NNNNNNNNNN NNNNNNNNNN
108301 NNNNNNNNNN NNNNNNNNNN NNNNNNNNNN NNNNNNNNNN NNNNNNNNNN
108351 NNNNNNNNNN NNNNNNNNNN NNNNNNNNNN NNNNNNNNNN NNNNNNNNNN
108401 NNNNNNNNNN NNNNNNNNNN NNNNNNNNNN NNNNNNNNNN NNNNNNNNNN
108451 NNNNNNNNNN NNNNNNNNNN NNNNNNNNNN NNNNNNNNNN NNNNNNNNNN
108501 NNNNNNNNNN NNNNNNNNNN NNNNNNNNNN NNNNNNNNNN NNNNNNNNNN
108551 NNNNNNNNNN NNNNNNNNNN NNNNNNNNNN NNNNNNNNNN NNNNNNNNNN
108601 NNNNNNNNNN NNNNNNNNNN NNNNNNNNNN NNNNNNNNNN NNNNNNNNNN
108651 NNNNNNNNNN NNNNNNNNNN NNNNNNNNNN NNNNNNNNNN NNNNNNNNNN
108701 NNNNNNNNNN NNNNNNNNNN NNNNNNNNNN NNNNNNNNNN NNNNNNNNNN
108751 NNNNNNNNNN NNNNNNNNNN NNNNNNNNNN NNNNNNNNNN NNNNNNNNNN

FIGURE 3FF

108801 NNNNNNNNNN NNNNNNNNNN NNNNNNNNNN NNNNNNNNNN NNNNNNNNNN
108851 NNNNNNNNNN NNNNNNNNNN NNNNNNNNNN NNNNNNNNNN NNNNNNNNNN
108901 NNNNNNNNNN NNNNNNNNNN NNNNNNNNNN NNNNNNNNNN NNNNNNNNNN
108951 NNNNNNNNNN NNNNNNNNNN NNNNNNNNNN NNNNNNNNNN NNNNNNNNNN
109001 NNNNNNNNNN NNNNNNNNNN NNNNNNNNNN NNNNNNNNNN NNNNNNNNNN
109051 NNNNNNNNNN NNNNNNNNNN NNNNNNNNNN NNNNNNNNNN NNNNNNNNNN
109101 NNNNNNNNNN NNNNNNNNNN NNNNNNNNNN NNNNNNNNNN NNNNNNNNNN
109151 NNNNNNNNNN NNNNNNNNNN NNNNNNNNNN NNNNNNNNNN NNNNNNNNNN
109201 NNNNNNNNNN NNNNNNNNNN NNNNNNNNNN NNNNNNNNNN NNNNNNNNNN
109251 NNNNNNNNNN NNNNNNNNNN NNNNNNNNNN NNNNNNNNNN NNNNNNNNNN
109301 NNNNNNNNNN NNNNNNNNNN NNNNNNNNNN NNNNNNNNNN NNNNNNNNNN
109351 NNNNNNNNNN NNNNNNNNNN NNNNNNNNNN NNNNNNNNNN NNNNNNNNNN
109401 NNNNNNNNNN NNNNNNNNNN NNNNNNNNNN NNNNNNNNNN NNNNNNNNNN
109451 NNNNNNNNNN NNNNNNNNNN NNNNNNNNNN NNNNNNNNNN NNNNNNNNNN
109501 NNNNNNNNNN NNNNNNNNNN NNNNNNNNNN NNNNNNNNNN NNNNNNNNNN
109551 NNNNNNNNNN NNNNNNNNNN NNNNNNNNNN NNNNNNNNNN NNNNNNNNNN
109601 NNNNNNNNNN NNNNNNNNNN NNNNNNNNNN NNNNNNNNNN NNNNNNNNNN
109651 NNNNNNNNNN NNNNNNNNNN NNNNNNNNNN NNNNNNNNNN NNNNNNNNNN
109701 NNNNNNNNNN NNNNNNNNNN NNNNNNNNNN NNNNNNNNNN NNNNNNNNNN
109751 NNNNNNNNNN NNNNNNNNNN NNNNNNNNNN NNNNNNNNNN NNNNNNNNNN
109801 NNNNNNNNNN NNNNNNNNNN NNNNNNNNNN NNNNNNNNNN NNNNNNNNNN
109851 NNNNNNNNNN NNNNNNNNNN NNNNNNNNNN NNNNNNNNNN NNNNNNNNNN
109901 NNNNNNNNNN NNNNNNNNNN NNNNNNNNNN NNNNNNNNNN NNNNNNNNNN
109951 NNNNNNNNNN NNNNNNNNNN NNNNNNNNNN NNNNNNNNNN NNNNNNNNNN
110001 NNNNNNNNNN NNNNNNNNNN NNNNNNNNNN NNNNNNNNNN NNNNNNNNNN
110051 NNNNNNNNNN NNNNNNNNNN NNNNNNNNNN NNNNNNNNNN NNNNNNNNNN
110101 NNNNNNNNNN NNNNNNNNNN NNNNNNNNNN NNNNNNNNNN NNNNNNNNNN
110151 NNNNNNNNNN NNNNNNNNNN NNNNNNNNNN NNNNNNNNNN NNNNNNNNNN
110201 NNNNNNNNNN NNNNNNNNNN NNNNNNNNNN NNNNNNNNNN NNNNNNNNNN
110251 NNNNNNNNNN NNNNNNNNNN NNNNNNNNNN NNNNNNNNNN NNNNNNNNNN
110301 NNNNNNNNNN NNNNNNNNNN NNNNNNNNNN NNNNNNNNNN NNNNNNNNNN
110351 NNNNNNNNNN NNNNNNNNNN NNNNNNNNNN NNNNNNNNNN NNNNNNNNNN
110401 NNNNNNNNNN NNNNNNNNNN NNNNNNNNNN NNNNNNNNNN NNNNNNNNNN
110451 NNNNNNNNNN NNNNNNNNNN NNNNNNNNNN NNNNNNNNNN NNNNNNNNNN
110501 NNNNNNNNNN NNNNNNNNNN NNNNNNNNNN NNNNNNNNNN NNNNNNNNNN
110551 NNNNNNNNNN NNNNNNNNNN NNNNNNNNNN NNNNNNNNNN NNNNNNNNNN
110601 NNNNNNNNNN NNNNNNNNNN NNNNNNNNNN NNNNNNNNNN NNNNNNNNNN
110651 NNNNNNNNNN NNNNNNNNNN NNNNNNNNNN NNNNNNNNNN NNNNNNNNNN
110701 NNNNNNNNNN NNNNNNNNNN NNNNNNNNNN NNNNNNNNNN NNNNNNNNNN
110751 NNNNNNNNNN NNNNNNNNNN NNNNNNNNNN NNNNNNNNNN NNNNNNNNNN
110801 NNNNNNNNNN NNNNNNNNNN NNNNNNNNNN NNNNNNNNNN NNNNNNNNNN
110851 NNNNNNNNNN NNNNNNNNNN NNNNNNNNNN NNNNNNNNNN NNNNNNNNNN
110901 NNNNNNNNNN NNNNNNNNNN NNNNNNNNNN NNNNNNNNNN NNNNNNNNNN
110951 NNNNNNNNNN NNNNNNNNNN NNNNNNNNNN NNNNNNNNNN NNNNNNNNNN
111001 NNNNNNNNNN NNNNNNNNNN NNNNNNNNNN NNNNNNNNNN NNNNNNNNNN
111051 NNNNNNNNNN NNNNNNNNNN NNNNNNNNNN NNNNNNNNNN NNNNNNNNNN
111101 NNNNNNNNNN NNNNNNNNNN NNNNNNNNNN NNNNNNNNNN NNNNNNNNNN
111151 NNNNNNNNNN NNNNNNNNNN NNNNNNNNNN NNNNNNNNNN NNNNNNNNNN
111201 NNNNNNNNNN NNNNNNNNNN NNNNNNNNNN NNNNNNNNNN NNNNNNNNNN
111251 NNNNNNNNNN NNNNNNNNNN NNNNNNNNNN NNNNNNNNNN NNNNNNNNNN
111301 NNNNNNNNNN NNNNNNNNNN NNNNNNNNNN NNNNNNNNNN NNNNNNNNNN
111351 NNNNNNNNNN NNNNNNNNNN NNNNNNNNNN NNNNNNNNNN NNNNNNNNNN
111401 NNNNNNNNNN NNNNNNNNNN NNNNNNNNNN NNNNNNNNNN NNNNNNNNNN
111451 NNNNNNNNNN NNNNNNNNNN NNNNNNNNNN NNNNNNNNNN NNNNNNNNNN
111501 NNNNNNNNNN NNNNNNNNNN NNNNNNNNNN NNNNNNNNNN NNNNNNNNNN
111551 NNNNNNNNNN NNNNNNNNNN NNNNNNNNNN NNNNNNNNNN NNNNNNNNNN
111601 NNNNNNNNNN NNNNNNNNNN NNNNNNNNNN NNNNNNNNNN NNNNNNNNNN
111651 NNNNNNNNNN NNNNNNNNNN NNNNNNNNNN NNNNNNNNNN NNNNNNNNNN
111701 NNNNNNNNNN NNNNNNNNNN NNNNNNNNNN NNNNNNNNNN NNNNNNNNNN
111751 NNNNNNNNNN NNNNNNNNNN NNNNNNNNNN NNNNNNNNNN NNNNNNNNNN
111801 NNNNNNNNNN NNNNNNNNNN NNNNNNNNNN NNNNNNNNNN NNNNNNNNNN
111851 NNNNNNNNNN NNNNNNNNNN NNNNNNNNNN NNNNNNNNNN NNNNNNNNNN
111901 NNNNNNNNNN NNNNNNNNNN NNNNNNNNNN NNNNNNNNNN NNNNNNNNNN
111951 NNNNNNNNNN NNNNNNNNNN NNNNNNNNNN NNNNNNNNNN NNNNNNNNNN
112001 NNNNNNNNNN NNNNNNNNNN NNNNNNNNNN NNNNNNNNNN NNNNNNNNNN
112051 NNNNNNNNNN NNNNNNNNNN NNNNNNNNNN NNNNNNNNNN NNNNNNNNNN
112101 NNNNNNNNNN NNNNNNNNNN NNNNNNNNNN NNNNNNNNNN NNNNNNNNNN
112151 NNNNNNNNNN NNNNNNNNNN NNNNNNNNNN NNNNNNNNNN NNNNNNNNNN

FIGURE 3GG

112201 NNNNNNNNNN NNNNNNNNNN NNNNNNNNNN NNNNNNNNNN NNNNNNNNNN
112251 NNNNNNNNNN NNNNNNNNNN NNNNNNNNNN NNNNNNNNNN NNNNNNNNNN
112301 NNNNNNNNNN NNNNNNNNNN NNNNNNNNNN NNNNNNNNNN NNNNNNNNNN
112351 NNNNNNNNNN NNNNNNNNNN NNNNNNNNNN NNNNNNNNNN NNNNNNNNNN
112401 NNNNNNNNNN NNNNNNNNNN NNNNNNNNNN NNNNNNNNNN NNNNNNNNNN
112451 NNNNNNNNNN NNNNNNNNNN NNNNNNNNNN NNNNNNNNNN NNNNNNNNNN
112501 NNNNNNNNNN NNNNNNNNNN NNNNNNNNNN NNNNNNNNNN NNNNNNNNNN
112551 NNNNNNNNNN NNNNNNNNNN NNNNNNNNNN NNNNNNNNNN NNNNNNNNNN
112601 NNNNNNNNNN NNNNNNNNNN NNNNNNNNNN NNNNNNNNNN NNNNNNNNNN
112651 NNNNNNNNNN NNNNNNNNNN NNNNNNNNNN NNNNNNNNNN NNNNNNNNNN
112701 NNNNNNNNNN NNNNNNNNNN NNNNNNNNNN NNNNNNNNNN NNNNNNNNNN
112751 NNNNNNNNNN NNNNNNNNNN NNNNNNNNNN NNNNNNNNNN NNNNNNNNNN
112801 NNNNNNNNNN NNNNNNNNNN NNNNNNNNNN NNNNNNNNNN NNNNNNNNNN
112851 NNNNNNNNNN NNNNNNNNNN NNNNNNNNNN NNNNNNNNNN NNNNNNNNNN
112901 NNNNNNNNNN NNNNNNNNNN NNNNNNNNNN NNNNNNNNNN NNNNNNNNNN
112951 NNNNNNNNNN NNNNNNNNNN NNNNNNNNNN NNNNNNNNNN NNNNNNNNNN
113001 NNNNNNNNNN NNNNNNNNNN NNNNNNNNNN NNNNNNNNNN NNNNNNNNNN
113051 NNNNNNNNNN NNNNNNNNNN NNNNNNNNNN NNNNNNNNNN NNNNNNNNNN
113101 NNNNNNNNNN NNNNNNNNNN NNNNNNNNNN NNNNNNNNNN NNNNNNNNNN
113151 NNNNNNNNNN NNNNNNNNNN NNNNNNNNNN NNNNNNNNNN NNNNNNNNNN
113201 NNNNNNNNNN NNNNNNNNNN NNNNNNNNNN NNNNNNNNNN NNNNNNNNNN
113251 NNNNNNNNNN NNNNNNNNNN NNNNNNNNNN NNNNNNNNNN NNNNNNNNNN
113301 NNNNNNNNNN NNNNNNNNNN NNNNNNNNNN NNNNNNNNNN NNNNNNNNNN
113351 NNNNNNNNNN NNNNNNNNNN NNNNNNNNNN NNNNNNNNNN NNNNNNNNNN
113401 NNNNNNNNNN NNNNNNNNNN NNNNNNNNNN NNNNNNNNNN NNNNNNNNNN
113451 NNNNNNNNNN NNNNNNNNNN NNNNNNNNNN NNNNNNNNNN NNNNNNNNNN
113501 NNNNNNNNNN NNNNNNNNNN NNNNNNNNNN NNNNNNNNNN NNNNNNNNNN
113551 NNNNNNNNNN NNNNNNNNNN NNNNNNNNNN NNNNNNNNNN NNNNNNNNNN
113601 NNNNNNNNNN NNNNNNNNNN NNNNNNNNNN NNNNNNNNNN NNNNNNNNNN
113651 NNNNNNNNNN NNNNNNNNNN NNNNNNNNNN NNNNNNNNNN NNNNNNNNNN
113701 NNNNNNNNNN NNNNNNNNNN NNNNNNNNNN NNNNNNNNNN NNNNNNNNNN
113751 NNNNNNNNNN NNNNNNNNNN NNNNNNNNNN NNNNNNNNNN NNNNNNNNNN
113801 NNNNNNNNNN NNNNNNNNNN NNNNNNNNNN NNNNNNNNNN NNNNNNNNNN
113851 NNNNNNNNNN NNNNNNNNNN NNNNNNNNNN NNNNNNNNNN NNNNNNNNNN
113901 NNNNNNNNNN NNNNNNNNNN NNNNNNNNNN NNNNNNNNNN NNNNNNNNNN
113951 NNNNNNNNNN NNNNNNNNNN NNNNNNNNNN NNNNNNNNNN NNNNNNNNNN
114001 NNNNNNNNNN NNNNNNNNNN NNNNNNNNNN NNNNNNNNNN NNNNNNNNNN
114051 NNNNNNNNNN NNNNNNNNNN NNNNNNNNNN NNNNNNNNNN NNNNNNNNNN
114101 NNNNNNNNNN NNNNNNNNNN NNNNNNNNNN NNNNNNNNNN NNNNNNNNNN
114151 NNNNNNNNNN NNNNNNNNNN NNNNNNNNNN NNNNNNNNNN NNNNNNNNNN
114201 NNNNNNNNNN NNNNNNNNNN NNNNNNNNNN NNNNNNNNNN NNNNNNNNNN
114251 NNNNNNNNNN NNNNNNNNNN NNNNNNNNNN NNNNNNNNNN NNNNNNNNNN
114301 NNNNNNNNNN NNNNNNNNNN NNNNNNNNNN NNNNNNNNNN NNNNNNNNNN
114351 NNNNNNNNNN NNNNNNNNNN NNNNNNNNNN NNNNNNNNNN NNNNNNNNNN
114401 NNNNNNNNNN NNNNNNNNNN NNNNNNNNNN NNNNNNNNNN NNNNNNNNNN
114451 NNNNNNNNNN NNNNNNNNNN NNNNNNNNNN NNNNNNNNNN NNNNNNNNNN
114501 NNNNNNNNNN NNNNNNNNNN NNNNNNNNNN NNNNNNNNNN NNNNNNNNNN
114551 NNNNNNNNNN NNNNNNNNNN NNNNNNNNNN NNNNNNNNNN NNNNNNNNNN
114601 NNNNNNNNNN NNNNNNNNNN NNNNNNNNNN NNNNNNNNNN NNNNNNNNNN
114651 NNNNNNNNNN NNNNNNNNNN NNNNNNNNNN NNNNNNNNNN NNNNNNNNNN
114701 NNNNNNNNNN NNNNNNNNNN NNNNNNNNNN NNNNNNNNNN NNNNNNNNNN
114751 NNNNNNNNNN NNNNNNNNNN NNNNNNNNNN NNNNNNNNNN NNNNNNNNNN
114801 NNNNNNNNNN NNNNNNNNNN NNNNNNNNNN NNNNNNNNNN NNNNNNNNNN
114851 NNNNNNNNNN NNNNNNNNNN NNNNNNNNNN NNNNNNNNNN NNNNNNNNNN
114901 NNNNNNNNNN NNNNNNNNNN NNNNNNNNNN NNNNNNNNNN NNNNNNNNNN
114951 NNNNNNNNNN NNNNNNNNNN NNNNNNNNNN NNNNNNNNNN NNNNNNNNNN
115001 NNNNNNNNNN NNNNNNNNNN NNNNNNNNNN NNNNNNNNNN NNNNNNNNNN
115051 NNNNNNNNNN NNNNNNNNNN NNNNNNNNNN NNNNNNNNNN NNNNNNNNNN
115101 NNNNNNNNNN NNNNNNNNNN NNNNNNNNNN NNNNNNNNNN NNNNNNNNNN
115151 NNNNNNNNNN NNNNNNNNNN NNNNNNNNNN NNNNNNNNNN NNNNNNNNNN
115201 NNNNNNNNNN NNNNNNNNNN NNNNNNNNNN NNNNNNNNNN NNNNNNNNNN
115251 NNNNNNNNNN NNNNNNNNNN NNNNNNNNNN NNNNNNNNNN NNNNNNNNNN
115301 NNNNNNNNNN NNNNNNNNNN NNNNNNNNNN NNNNNNNNNN NNNNNNNNNN
115351 NNNNNNNNNN NNNNNNNNNN NNNNNNNNNN NNNNNNNNNN NNNNNNNNNN
115401 NNNNNNNNNN NNNNNNNNNN NNNNNNNNNN NNNNNNNNNN NNNNNNNNNN
115451 NNNNNNNNNN NNNNNNNNNN NNNNNNNNNN NNNNNNNNNN NNNNNNNNNN
115501 NNNNNNNNNN NNNNNNNNNN NNNNNNNNNN NNNNNNNNNN NNNNNNNNNN
115551 NNNNNNNNNN NNNNNNNNNN NNNNNNNNNN NNNNNNNNNN NNNNNNNNNN

FIGURE 3HH

115601 NNNNNNNNNN NNNNNNNNNN NNNNNNNNNN NNNNNNNNNN NNNNNNNNNN
115651 NNNNNNNNNN NNNNNNNNNN NNNNNNNNNN NNNNNNNNNN NNNNNNNNNN
115701 NNNNNNNNNN NNNNNNNNNN NNNNNNNNNN NNNNNNNNNN NNNNNNNNNN
115751 NNNNNNNNNN NNNNNNNNNN NNNNNNNNNN NNNNNNNNNN NNNNNNNNNN
115801 NNNNNNNNNN NNNNNNNNNN NNNNNNNNNN NNNNNNNNNN NNNNNNNNNN
115851 NNNNNNNNNN NNNNNNNNNN NNNNNNNNNN NNNNNNNNNN NNNNNNNNNN
115901 NNNNNNNNNN NNNNNNNNNN NNNNNNNNNN NNNNNNNNNN NNNNNNNNNN
115951 NNNNNNNNNN NNNNNNNNNN NNNNNNNNNN NNNNNNNNNN NNNNNNNNNN
116001 NNNNNNNNNN NNNNNNNNNN NNNNNNNNNN NNNNNNNNNN NNNNNNNNNN
116051 NNNNNNNNNN NNNNNNNNNN NNNNNNNNNN NNNNNNNNNN NNNNNNNNNN
116101 NNNNNNNNNN NNNNNNNNNN NNNNNNNNNN NNNNNNNNNN NNNNNNNNNN
116151 NNNNNNNNNN NNNNNNNNNN NNNNNNNNNN NNNNNNNNNN NNNNNNNNNN
116201 NNNNNNNNNN NNNNNNNNNN NNNNNNNNNN NNNNNNNNNN NNNNNNNNNN
116251 NNNNNNNNNN NNNNNNNNNN NNNNNNNNNN NNNNNNNNNN NNNNNNNNNN
116301 NNNNNNNNNN NNNNNNNNNN NNNNNNNNNN NNNNNNNNNN NNNNNNNNNN
116351 NNNNNNNNNN NNNNNNNNNN NNNNNNNNNN NNNNNNNNNN NNNNNNNNNN
116401 NNNNNNNNNN NNNNNNNNNN NNNNNNNNNN NNNNNNNNNN NNNNNNNNNN
116451 NNNNNNNNNN NNNNNNNNNN NNNNNNNNNN NNNNNNNNNN NNNNNNNNNN
116501 NNNNNNNNNN NNNNNNNNNN NNNNNNNNNN NNNNNNNNNN NNNNNNNNNN
116551 NNNNNNNNNN NNNNNNNNNN NNNNNNNNNN NNNNNNNNNN NNNNNNNNNN
116601 NNNNNNNNNN NNNNNNNNNN NNNNNNNNNN NNNNNNNNNN NNNNNNNNNN
116651 NNNNNNNNNN NNNNNNNNNN NNNNNNNNNN NNNNNNNNNN NNNNNNNNNN
116701 NNNNNNNNNN NNNNNNNNNN NNNNNNNNNN NNNNNNNNNN NNNNNNNNNN
116751 NNNNNNNNNN NNNNNNNNNN NNNNNNNNNN NNNNNNNNNN NNNNNNNNNN
116801 NNNNNNNNNN NNNNNNNNNN NNNNNNNNNN NNNNNNNNNN NNNNNNNNNN
116851 NNNNNNNNNN NNNNNNNNNN NNNNNNNNNN NNNNNNNNNN NNNNNNNNNN
116901 NNNNNNNNNN NNNNNNNNNN NNNNNNNNNN NNNNNNNNNN NNNNNNNNNN
116951 NNNNNNNNNN NNNNNNNNNN NNNNNNNNNN NNNNNNNNNN NNNNNNNNNN
117001 NNNNNNNNNN NNNNNNNNNN NNNNNNNNNN NNNNNNNNNN NNNNNNNNNN
117051 NNNNNNNNNN NNNNNNNNNN NNNNNNNNNN NNNNNNNNNN NNNNNNNNNN
117101 NNNNNNNNNN NNNNNNNNNN NNNNNNNNNN NNNNNNNNNN NNNNNNNNNN
117151 NNNNNNNNNN NNNNNNNNNN NNNNNNNNNN NNNNNNNNNN NNNNNNNNNN
117201 NNNNNNNNNN NNNNNNNNNN NNNNNNNNNN NNNNNNNNNN NNNNNNNNNN
117251 NNNNNNNNNN NNNNNNNNNN NNNNNNNNNN NNNNNNNNNN NNNNNNNNNN
117301 NNNNNNNNNN NNNNNNNNNN NNNNNNNNNN NNNNNNNNNN NNNNNNNNNN
117351 NNNNNNNNNN NNNNNNNNNN NNNNNNNNNN NNNNNNNNNN NNNNNNNNNN
117401 NNNNNNNNNN NNNNNNNNNN NNNNNNNNNN NNNNNNNNNN NNNNNNNNNN
117451 NNNNNNNNNN NNNNNNNNNN NNNNNNNNNN NNNNNNNNNN NNNNNNNNNN
117501 NNNNNNNNNN NNNNNNNNNN NNNNNNNNNN NNNNNNNNNN NNNNNNNNNN
117551 NNNNNNNNNN NNNNNNNNNN NNNNNNNNNN NNNNNNNNNN NNNNNNNNNN
117601 NNNNNNNNNN NNNNNNNNNN NNNNNNNNNN NNNNNNNNNN NNNNNNNNNN
117651 NNNNNNNNNN NNNNNNNNNN NNNNNNNNNN NNNNNNNNNN NNNNNNNNNN
117701 NNNNNNNNNN NNNNNNNNNN NNNNNNNNNN NNNNNNNNNN NNNNNNNNNN
117751 NNNNNNNNNN NNNNNNNNNN NNNNNNNNNN NNNNNNNNNN NNNNNNNNNN
117801 NNNNNNNNNN NNNNNNNNNN NNNNNNNNNN NNNNNNNNNN NNNNNNNNNN
117851 NNNNNNNNNN NNNNNNNNNN NNNNNNNNNN NNNNNNNNNN NNNNNNNNNN
117901 NNNNNNNNNN NNNNNNNNNN NNNNNNNNNN NNNNNNNNNN NNNNNNNNNN
117951 NNNNNNNNNN NNNNNNNNNN NNNNNNNNNN NNNNNNNNNN NNNNNNNNNN
118001 NNNNNNNNNN NNNNNNNNNN NNNNNNNNNN NNNNNNNNNN NNNNNNNNNN
118051 NNNNNNNNNN NNNNNNNNNN NNNNNNNNNN NNNNNNNNNN NNNNNNNNNN
118101 NNNNNNNNNN NNNNNNNNNN NNNNNNNNNN NNNNNNNNNN NNNNNNNNNN
118151 NNNNNNNNNN NNNNNNNNNN NNNNNNNNNN NNNNNNNNNN NNNNNNNNNN
118201 NNNNNNNNNN NNNNNNNNNN NNNNNNNNNN NNNNNNNNNN NNNNNNNNNN
118251 NNNNNNNNNN NNNNNNNNNN NNNNNNNNNN NNNNNNNNNN NNNNNNNNNN
118301 NNNNNNNNNN NNNNNNNNNN NNNNNNNNNN NNNNNNNNNN NNNNNNNNNN
118351 NNNNNNNNNN NNNNNNNNNN NNNNNNNNNN NNNNNNNNNN NNNNNNNNNN
118401 NNNNNNNNNN NNNNNNNNNN NNNNNNNNNN NNNNNNNNNN NNNNNNNNNN
118451 NNNNNNNNNN NNNNNNNNNN NNNNNNNNNN NNNNNNNNNN NNNNNNNNNN
118501 NNNNNNNNNN NNNNNNNNNN NNNNNNNNNN NNNNNNNNNN NNNNNNNNNN
118551 NNNNNNNNNN NNNNNNNNNN NNNNNNNNNN NNNNNNNNNN NNNNNNNNNN
118601 NNNNNNNNNN NNNNNNNNNN NNNNNNNNNN NNNNNNNNNN NNNNNNNNNN
118651 NNNNNNNNNN NNNNNNNNNN NNNNNNNNNN NNNNNNNNNN NNNNNNNNNN
118701 NNNNNNNNNN NNNNNNNNNN NNNNNNNNNN NNNNNNNNNN NNNNNNNNNN
118751 NNNNNNNNNN NNNNNNNNNN NNNNNNNNNN NNNNNNNNNN NNNNNNNNNN
118801 NNNNNNNNNN NNNNNNNNNN NNNNNNNNNN NNNNNNNNNN NNNNNNNNNN
118851 NNNNNNNNNN NNNNNNNNNN NNNNNNNNNN NNNNNNNNNN NNNNNNNNNN
118901 NNNNNNNNNN NNNNNNNNNN NNNNNNNNNN NNNNNNNNNN NNNNNNNNNN
118951 NNNNNNNNNN NNNNNNNNNN NNNNNNNNNN NNNNNNNNNN NNNNNNNNNN

FIGURE 3II

119001 NNNNNNNNNN NNNNNNNNNN NNNNNNNNNN NNNNNNNNNN NNNNNNNNNN
119051 NNNNNNNNNN NNNNNNNNNN NNNNNNNNNN NNNNNNNNNN NNNNNNNNNN
119101 NNNNNNNNNN NNNNNNNNNN NNNNNNNNNN NNNNNNNNNN NNNNNNNNNN
119151 NNNNNNNNNN NNNNNNNNNN NNNNNNNNNN NNNNNNNNNN NNNNNNNNNN
119201 NNNNNNNNNN NNNNNNNNNN NNNNNNNNNN NNNNNNNNNN NNNNNNNNNN
119251 NNNNNNNNNN NNNNNNNNNN NNNNNNNNNN NNNNNNNNNN NNNNNNNNNN
119301 NNNNNNNNNN NNNNNNNNNN NNNNNNNNNN NNNNNNNNNN NNNNNNNNNN
119351 NNNNNNNNNN NNNNNNNNNN NNNNNNNNNN NNNNNNNNNN NNNNNNNNNN
119401 NNNNNNNNNN NNNNNNNNNN NNNNNNNNNN NNNNNNNNNN NNNNNNNNNN
119451 NNNNNNNNNN NNNNNNNNNN NNNNNNNNNN NNNNNNNNNN NNNNNNNNNN
119501 NNNNNNNNNN NNNNNNNNNN NNNNNNNNNN NNNNNNNNNN NNNNNNNNNN
119551 NNNNNNNNNN NNNNNNNNNN NNNNNNNNNN NNNNNNNNNN NNNNNNNNNN
119601 NNNNNNNNNN NNNNNNNNNN NNNNNNNNNN NNNNNNNNNN NNNNNNNNNN
119651 NNNNNNNNNN NNNNNNNNNN NNNNNNNNNN NNNNNNNNNN NNNNNNNNNN
119701 NNNNNNNNNN NNNNNNNNNN NNNNNNNNNN NNNNNNNNNN NNNNNNNNNN
119751 NNNNNNNNNN NNNNNNNNNN NNNNNNNNNN NNNNNNNNNN NNNNNNNNNN
119801 NNNNNNNNNN NNNNNNNNNN NNNNNNNNNN NNNNNNNNNN NNNNNNNNNN
119851 NNNNNNNNNN NNNNNNNNNN NNNNNNNNNN NNNNNNNNNN NNNNNNNNNN
119901 NNNNNNNNNN NNNNNNNNNN NNNNNNNNNN NNNNNNNNNN NNNNNNNNNN
119951 NNNNNNNNNN NNNNNNNNNN NNNNNNNNNN NNNNNNNNNN NNNNNNNNNN
120001 NNNNNNNNNN NNNNNNNNNN NNNNNNNNNN NNNNNNNNNN NNNNNNNNNN
120051 NNNNNNNNNN NNNNNNNNNN NNNNNNNNNN NNNNNNNNNN NNNNNNNNNN
120101 NNNNNNNNNN NNNNNNNNNN NNNNNNNNNN NNNNNNNNNN NNNNNNNNNN
120151 NNNNNNNNNN NNNNNNNNNN NNNNNNNNNN NNNNNNNNNN NNNNNNNNNN
120201 NNNNNNNNNN NNNNNNNNNN NNNNNNNNNN NNNNNNNNNN NNNNNNNNNN
120251 NNNNNNNNNN NNNNNNNNNN NNNNNNNNNN NNNNNNNNNN NNNNNNNNNN
120301 NNNNNNNNNN NNNNNNNNNN NNNNNNNNNN NNNNNNNNNN NNNNNNNNNN
120351 NNNNNNNNNN NNNNNNNNNN NNNNNNNNNN NNNNNNNNNN NNNNNNNNNN
120401 NNNNNNNNNN NNNNNNNNNN NNNNNNNNNN NNNNNNNNNN NNNNNNNNNN
120451 NNNNNNNNNN NNNNNNNNNN NNNNNNNNNN NNNNNNNNNN NNNNNNNNNN
120501 NNNNNNNNNN NNNNNNNNNN NNNNNNNNNN NNNNNNNNNN NNNNNNNNNN
120551 NNNNNNNNNN NNNNNNNNNN NNNNNNNNNN NNNNNNNNNN NNNNNNNNNN
120601 NNNNNNNNNN NNNNNNNNNN NNNNNNNNNN NNNNNNNNNN NNNNNNNNNN
120651 NNNNNNNNNN NNNNNNNNNN NNNNNNNNNN NNNNNNNNNN NNNNNNNNNN
120701 NNNNNNNNNN NNNNNNNNNN NNNNNNNNNN NNNNNNNNNN NNNNNNNNNN
120751 NNNNNNNNNN NNNNNNNNNN NNNNNNNNNN NNNNNNNNNN NNNNNNNNNN
120801 NNNNNNNNNN NNNNNNNNNN NNNNNNNNNN NNNNNNNNNN NNNNNNNNNN
120851 NNNNNNNNNN NNNNNNNNNN NNNNNNNNNN NNNNNNNNNN NNNNNNNNNN
120901 NNNNNNNNNN NNNNNNNNNN NNNNNNNNNN NNNNNNNNNN NNNNNNNNNN
120951 NNNNNNNNNN NNNNNNNNNN NNNNNNNNNN NNNNNNNNNN NNNNNNNNNN
121001 NNNNNNNNNN NNNNNNNNNN NNNNNNNNNN NNNNNNNNNN NNNNNNNNNN
121051 NNNNNNNNNN NNNNNNNNNN NNNNNNNNNN NNNNNNNNNN NNNNNNNNNN
121101 NNNNNNNNNN NNNNNNNNNN NNNNNNNNNN NNNNNNNNNN NNNNNNNNNN
121151 NNNNNNNNNN NNNNNNNNNN NNNNNNNNNN NNNNNNNNNN NNNNNNNNNN
121201 NNNNNNNNNN NNNNNNNNNN NNNNNNNNNN NNNNNNNNNN NNNNNNNNNN
121251 NNNNNNNNNN NNNNNNNNNN NNNNNNNNNN NNNNNNNNNN NNNNNNNNNN
121301 NNNNNNNNNN NNNNNNNNNN NNNNNNNNNN NNNNNNNNNN NNNNNNNNNN
121351 NNNNNNNNNN NNNNNNNNNN NNNNNNNNNN NNNNNNNNNN NNNNNNNNNN
121401 NNNNNNNNNN NNNNNNNNNN NNNNNNNNNN NNNNNNNNNN NNNNNNNNNN
121451 NNNNNNNNNN NNNNNNNNNN NNNNNNNNNN NNNNNNNNNN NNNNNNNNNN
121501 NNNNNNNNNN NNNNNNNNNN NNNNNNNNNN NNNNNNNNNN NNNNNNNNNN
121551 NNNNNNNNNN NNNNNNNNNN NNNNNNNNNN NNNNNNNNNN NNNNNNNNNN
121601 NNNNNNNNNN NNNNNNNNNN NNNNNNNNNN NNNNNNNNNN NNNNNNNNNN
121651 NNNNNNNNNN NNNNNNNNNN NNNNNNNNNN NNNNNNNNNN NNNNNNNNNN
121701 NNNNNNNNNN NNNNNNNNNN NNNNNNNNNN NNNNNNNNNN NNNNNNNNNN
121751 NNNNNNNNNN NNNNNNNNNN NNNNNNNNNN NNNNNNNNNN NNNNNNNNNN
121801 NNNNNNNNNN NNNNNNNNNN NNNNNNNNNN NNNNNNNNNN NNNNNNNNNN
121851 NNNNNNNNNN NNNNNNNNNN NNNNNNNNNN NNNNNNNNNN NNNNNNNNNN
121901 NNNNNNNNNN NNNNNNNNNN NNNNNNNNNN NNNNNNNNNN NNNNNNNNNN
121951 NNNNNNNNNN NNNNNNNNNN NNNNNNNNNN NNNNNNNNNN NNNNNNNNNN
122001 NNNNNNNNNN NNNNNNNNNN NNNNNNNNNN NNNNNNNNNN NNNNNNNNNN
122051 NNNNNNNNNN NNNNNNNNNN NNNNNNNNNN NNNNNNNNNN NNNNNNNNNN
122101 NNNNNNNNNN NNNNNNNNNN NNNNNNNNNN NNNNNNNNNN NNNNNNNNNN
122151 NNNNNNNNNN NNNNNNNNNN NNNNNNNNNN NNNNNNNNNN NNNNNNNNNN
122201 NNNNNNNNNN NNNNNNNNNN NNNNNNNNNN NNNNNNNNNN NNNNNNNNNN
122251 NNNNNNNNNN NNNNNNNNNN NNNNNNNNNN NNNNNNNNNN NNNNNNNNNN
122301 NNNNNNNNNN NNNNNNNNNN NNNNNNNNNN NNNNNNNNNN NNNNNNNNNN
122351 NNNNNNNNNN NNNNNNNNNN NNNNNNNNNN NNNNNNNNNN NNNNNNNNNN

FIGURE 3JJ

122401 NNNNNNNNNN NNNNNNNNNN NNNNNNNNNN NNNNNNNNNN NNNNNNNNNN
122451 NNNNNNNNNN NNNNNNNNNN NNNNNNNNNN NNNNNNNNNN NNNNNNNNNN
122501 NNNNNNNNNN NNNNNNNNNN NNNNNNNNNN NNNNNNNNNN NNNNNNNNNN
122551 NNNNNNNNNN NNNNNNNNNN NNNNNNNNNN NNNNNNNNNN NNNNNNNNNN
122601 NNNNNNNNNN NNNNNNNNNN NNNNNNNNNN NNNNNNNNNN NNNNNNNNNN
122651 NNNNNNNNNN NNNNNNNNNN NNNNNNNNNN NNNNNNNNNN NNNNNNNNNN
122701 NNNNNNNNNN NNNNNNNNNN NNNNNNNNNN NNNNNNNNNN NNNNNNNNNN
122751 NNNNNNNNNN NNNNNNNNNN NNNNNNNNNN NNNNNNNNNN NNNNNNNNNN
122801 NNNNNNNNNN NNNNNNNNNN NNNNNNNNNN NNNNNNNNNN NNNNNNNNNN
122851 NNNNNNNNNN NNNNNNNNNN NNNNNNNNNN NNNNNNNNNN NNNNNNNNNN
122901 NNNNNNNNNN NNNNNNNNNN NNNNNNNNNN NNNNNNNNNN NNNNNNNNNN
122951 NNNNNNNNNN NNNNNNNNNN NNNNNNNNNN NNNNNNNNNN NNNNNNNNNN
123001 NNNNNNNNNN NNNNNNNNNN NNNNNNNNNN NNNNNNNNNN NNNNNNNNNN
123051 NNNNNNNNNN NNNNNNNNNN NNNNNNNNNN NNNNNNNNNN NNNNNNNNNN
123101 NNNNNNNNNN NNNNNNNNNN NNNNNNNNNN NNNNNNNNNN NNNNNNNNNN
123151 NNNNNNNNNN NNNNNNNNNN NNNNNNNNNN NNNNNNNNNN NNNNNNNNNN
123201 NNNNNNNNNN NNNNNNNNNN NNNNNNNNNN NNNNNNNNNN NNNNNNNNNN
123251 NNNNNNNNNN NNNNNNNNNN NNNNNNNNNN NNNNNNNNNN NNNNNNNNNN
123301 NNNNNNNNNN NNNNNNNNNN NNNNNNNNNN NNNNNNNNNN NNNNNNNNNN
123351 NNNNNNNNNN NNNNNNNNNN NNNNNNNNNN NNNNNNNNNN NNNNNNNNNN
123401 NNNNNNNNNN NNNNNNNNNN NNNNNNNNNN NNNNNNNNNN NNNNNNNNNN
123451 NNNNNNNNNN NNNNNNNNNN NNNNNNNNNN NNNNNNNNNN NNNNNNNNNN
123501 NNNNNNNNNN NNNNNNNNNN NNNNNNNNNN NNNNNNNNNN NNNNNNNNNN
123551 NNNNNNNNNN NNNNNNNNNN NNNNNNNNNN NNNNNNNNNN NNNNNNNNNN
123601 NNNNNNNNNN NNNNNNNNNN NNNNNNNNNN NNNNNNNNNN NNNNNNNNNN
123651 NNNNNNNNNN NNNNNNNNNN NNNNNNNNNN NNNNNNNNNN NNNNNNNNNN
123701 NNNNNNNNNN NNNNNNNNNN NNNNNNNNNN NNNNNNNNNN NNNNNNNNNN
123751 NNNNNNNNNN NNNNNNNNNN NNNNNNNNNN NNNNNNNNNN NNNNNNNNNN
123801 NNNNNNNNNN NNNNNNNNNN NNNNNNNNNN NNNNNNNNNN NNNNNNNNNN
123851 NNNNNNNNNN NNNNNNNNNN NNNNNNNNNN NNNNNNNNNN NNNNNNNNNN
123901 NNNNNNNNNN NNNNNNNNNN NNNNNNNNNN NNNNNNNNNN NNNNNNNNNN
123951 NNNNNNNNNN NNNNNNNNNN NNNNNNNNNN NNNNNNNNNN NNNNNNNNNN
124001 NNNNNNNNNN NNNNNNNNNN NNNNNNNNNN NNNNNNNNNN NNNNNNNNNN
124051 NNNNNNNNNN NNNNNNNNNN NNNNNNNNNN NNNNNNNNNN NNNNNNNNNN
124101 NNNNNNNNNN NNNNNNNNNN NNNNNNNNNN NNNNNNNNNN NNNNNNNNNN
124151 NNNNNNNNNN NNNNNNNNNN NNNNNNNNNN NNNNNNNNNN NNNNNNNNNN
124201 NNNNNNNNNN NNNNNNNNNN NNNNNNNNNN NNNNNNNNNN NNNNNNNNNN
124251 NNNNNNNNNN NNNNNNNNNN NNNNNNNNNN NNNNNNNNNN NNNNNNNNNN
124301 NNNNNNNNNN NNNNNNNNNN NNNNNNNNNN NNNNNNNNNN NNNNNNNNNN
124351 NNNNNNNNNN NNNNNNNNNN NNNNNNNNNN NNNNNNNNNN NNNNNNNNNN
124401 NNNNNNNNNN NNNNNNNNNN NNNNNNNNNN NNNNNNNNNN NNNNNNNNNN
124451 NNNNNNNNNN NNNNNNNNNN NNNNNNNNNN NNNNNNNNNN NNNNNNNNNN
124501 NNNNNNNNNN NNNNNNNNNN NNNNNNNNNN NNNNNNNNNN NNNNNNNNNN
124551 NNNNNNNNNN NNNNNNNNNN NNNNNNNNNN NNNNNNNNNN NNNNNNNNNN
124601 NNNNNNNNNN NNNNNNNNNN NNNNNNNNNN NNNNNNNNNN NNNNNNNNNN
124651 NNNNNNNNNN NNNNNNNNNN NNNNNNNNNN NNNNNNNNNN NNNNNNNNNN
124701 NNNNNNNNNN NNNNNNNNNN NNNNNNNNNN NNNNNNNNNN NNNNNNNNNN
124751 NNNNNNNNNN NNNNNNNNNN NNNNNNNNNN NNNNNNNNNN NNNNNNNNNN
124801 NNNNNNNNNN NNNNNNNNNN NNNNNNNNNN NNNNNNNNNN NNNNNNNNNN
124851 NNNNNNNNNN NNNNNNNNNN NNNNNNNNNN NNNNNNNNNN NNNNNNNNNN
124901 NNNNNNNNNN NNNNNNNNNN NNNNNNNNNN NNNNNNNNNN NNNNNNNNNN
124951 NNNNNNNNNN NNNNNNNNNN NNNNNNNNNN NNNNNNNNNN NNNNNNNNNN
125001 NNNNNNNNNN NNNNNNNNNN NNNNNNNNNN NNNNNNNNNN NNNNNNNNNN
125051 NNNNNNNNNN NNNNNNNNNN NNNNNNNNNN NNNNNNNNNN NNNNNNNNNN
125101 NNNNNNNNNN NNNNNNNNNN NNNNNNNNNN NNNNNNNNNN NNNNNNNNNN
125151 NNNNNNNNNN NNNNNNNNNN NNNNNNNNNN NNNNNNNNNN NNNNNNNNNN
125201 NNNNNNNNNN NNNNNNNNNN NNNNNNNNNN NNNNNNNNNN NNNNNNNNNN
125251 NNNNNNNNNN NNNNNNNNNN NNNNNNNNNN NNNNNNNNNN NNNNNNNNNN
125301 NNNNNNNNNN NNNNNNNNNN NNNNNNNNNN NNNNNNNNNN NNNNNNNNNN
125351 NNNNNNNNNN NNNNNNNNNN NNNNNNNNNN NNNNNNNNNN NNNNNNNNNN
125401 NNNNNNNNNN NNNNNNNNNN NNNNNNNNNN NNNNNNNNNN NNNNNNNNNN
125451 NNNNNNNNNN NNNNNNNNNN NNNNNNNNNN NNNNNNNNNN NNNNNNNNNN
125501 NNNNNNNNNN NNNNNNNNNN NNNNNNNNNN NNNNNNNNNN NNNNNNNNNN
125551 NNNNNNNNNN NNNNNNNNNN NNNNNNNNNN NNNNNNNNNN NNNNNNNNNN
125601 NNNNNNNNNN NNNNNNNNNN NNNNNNNNNN NNNNNNNNNN NNNNNNNNNN
125651 NNNNNNNNNN NNNNNNNNNN NNNNNNNNNN NNNNNNNNNN NNNNNNNNNN
125701 NNNNNNNNNN NNNNNNNNNN NNNNNNNNNN NNNNNNNNNN NNNNNNNNNN
125751 NNNNNNNNNN NNNNNNNNNN NNNNNNNNNN NNNNNNNNNN NNNNNNNNNN

FIGURE 3KK

125801 NNNNNNNNNN NNNNNNNNNN NNNNNNNNNN NNNNNNNNNN NNNNNNNNNN
125851 NNNNNNNNNN NNNNNNNNNN NNNNNNNNNN NNNNNNNNNN NNNNNNNNNN
125901 NNNNNNNNNN NNNNNNNNNN NNNNNNNNNN NNNNNNNNNN NNNNNNNNNN
125951 NNNNNNNNNN NNNNNNNNNN NNNNNNNNNN NNNNNNNNNN NNNNNNNNNN
126001 NNNNNNNNNN NNNNNNNNNN NNNNNNNNNN NNNNNNNNNN NNNNNNNNNN
126051 NNNNNNNNNN NNNNNNNNNN NNNNNNNNNN NNNNNNNNNN NNNNNNNNNN
126101 NNNNNNNNNN NNNNNNNNNN NNNNNNNNNN NNNNNNNNNN NNNNNNNNNN
126151 NNNNNNNNNN NNNNNNNNNN NNNNNNNNNN NNNNNNNNNN NNNNNNNNNN
126201 NNNNNNNNNN NNNNNNNNNN NNNNNNNNNN NNNNNNNNNN NNNNNNNNNN
126251 NNNNNNNNNN NNNNNNNNNN NNNNNNNNNN NNNNNNNNNN NNNNNNNNNN
126301 NNNNNNNNNN NNNNNNNNNN NNNNNNNNNN NNNNNNNNNN NNNNNNNNNN
126351 NNNNNNNNNN NNNNNNNNNN NNNNNNNNNN NNNNNNNNNN NNNNNNNNNN
126401 NNNNNNNNNN NNNNNNNNNN NNNNNNNNNN NNNNNNNNNN NNNNNNNNNN
126451 NNNNNNNNNN NNNNNNNNNN NNNNNNNNNN NNNNNNNNNN NNNNNNNNNN
126501 NNNNNNNNNN NNNNNNNNNN NNNNNNNNNN NNNNNNNNNN NNNNNNNNNN
126551 NNNNNNNNNN NNNNNNNNNN NNNNNNNNNN NNNNNNNNNN NNNNNNNNNN
126601 NNNNNNNNNN NNNNNNNNNN NNNNNNNNNN NNNNNNNNNN NNNNNNNNNN
126651 NNNNNNNNNN NNNNNNNNNN NNNNNNNNNN NNNNNNNNNN NNNNNNNNNN
126701 NNNNNNNNNN NNNNNNNNNN NNNNNNNNNN NNNNNNNNNN NNNNNNNNNN
126751 NNNNNNNNNN NNNNNNNNNN NNNNNNNNNN NNNNNNNNNN NNNNNNNNNN
126801 NNNNNNNNNN NNNNNNNNNN NNNNNNNNNN NNNNNNNNNN NNNNNNNNNN
126851 NNNNNNNNNN NNNNNNNNNN NNNNNNNNNN NNNNNNNNNN NNNNNNNNNN
126901 NNNNNNNNNN NNNNNNNNNN NNNNNNNNNN NNNNNNNNNN NNNNNNNNNN
126951 NNNNNNNNNN NNNNNNNNNN NNNNNNNNNN NNNNNNNNNN NNNNNNNNNN
127001 NNNNNNNNNN NNNNNNNNNN NNNNNNNNNN NNNNNNNNNN NNNNNNNNNN
127051 NNNNNNNNNN NNNNNNNNNN NNNNNNNNNN NNNNNNNNNN NNNNNNNNNN
127101 NNNNNNNNNN NNNNNNNNNN NNNNNNNNNN NNNNNNNNNN NNNNNNNNNN
127151 NNNNNNNNNN NNNNNNNNNN NNNNNNNNNN NNNNNNNNNN NNNNNNNNNN
127201 NNNNNNNNNN NNNNNNNNNN NNNNNNNNNN NNNNNNNNNN NNNNNNNNNN
127251 NNNNNNNNNN NNNNNNNNNN NNNNNNNNNN NNNNNNNNNN NNNNNNNNNN
127301 NNNNNNNNNN NNNNNNNNNN NNNNNNNNNN NNNNNNNNNN NNNNNNNNNN
127351 NNNNNNNNNN NNNNNNNNNN NNNNNNNNNN NNNNNNNNNN NNNNNNNNNN
127401 NNNNNNNNNN NNNNNNNNNN NNNNNNNNNN NNNNNNNNNN NNNNNNNNNN
127451 NNNNNNNNNN NNNNNNNNNN NNNNNNNNNN NNNNNNNNNN NNNNNNNNNN
127501 NNNNNNNNNN NNNNNNNNNN NNNNNNNNNN NNNNNNNNNN NNNNNNNNNN
127551 NNNNNNNNNN NNNNNNNNNN NNNNNNNNNN NNNNNNNNNN NNNNNNNNNN
127601 NNNNNNNNNN NNNNNNNNNN NNNNNNNNNN NNNNNNNNNN NNNNNNNNNN
127651 NNNNNNNNNN NNNNNNNNNN NNNNNNNNNN NNNNNNNNNN NNNNNNNNNN
127701 NNNNNNNNNN NNNNNNNNNN NNNNNNNNNN NNNNNNNNNN NNNNNNNNNN
127751 NNNNNNNNNN NNNNNNNNNN NNNNNNNNNN NNNNNNNNNN NNNNNNNNNN
127801 NNNNNNNNNN NNNNNNNNNN NNNNNNNNNN NNNNNNNNNN NNNNNNNNNN
127851 NNNNNNNNNN NNNNNNNNNN NNNNNNNNNN NNNNNNNNNN NNNNNNNNNN
127901 NNNNNNNNNN NNNNNNNNNN NNNNNNNNNN NNNNNNNNNN NNNNNNNNNN
127951 NNNNNNNNNN NNNNNNNNNN NNNNNNNNNN NNNNNNNNNN NNNNNNNNNN
128001 NNNNNNNNNN NNNNNNNNNN NNNNNNNNNN NNNNNNNNNN NNNNNNNNNN
128051 NNNNNNNNNN NNNNNNNNNN NNNNNNNNNN NNNNNNNNNN NNNNNNNNNN
128101 NNNNNNNNNN NNNNNNNNNN NNNNNNNNNN NNNNNNNNNN NNNNNNNNNN
128151 NNNNNNNNNN NNNNNNNNNN NNNNNNNNNN NNNNNNNNNN NNNNNNNNNN
128201 NNNNNNNNNN NNNNNNNNNN NNNNNNNNNN NNNNNNNNNN NNNNNNNNNN
128251 NNNNNNNNNN NNNNNNNNNN NNNNNNNNNN NNNNNNNNNN NNNNNNNNNN
128301 NNNNNNNNNN NNNNNNNNNN NNNNNNNNNN NNNNNNNNNN NNNNNNNNNN
128351 NNNNNNNNNN NNNNNNNNNN NNNNNNNNNN NNNNNNNNNN NNNNNNNNNN
128401 NNNNNNNNNN NNNNNNNNNN NNNNNNNNNN NNNNNNNNNN NNNNNNNNNN
128451 NNNNNNNNNN NNNNNNNNNN NNNNNNNNNN NNNNNNNNNN NNNNNNNNNN
128501 NNNNNNNNNN NNNNNNNNNN NNNNNNNNNN NNNNNNNNNN NNNNNNNNNN
128551 NNNNNNNNNN NNNNNNNNNN NNNNNNNNNN NNNNNNNNNN NNNNNNNNNN
128601 NNNNNNNNNN NNNNNNNNNN NNNNNNNNNN NNNNNNNNNN NNNNNNNNNN
128651 NNNNNNNNNN NNNNNNNNNN NNNNNNNNNN NNNNNNNNNN NNNNNNNNNN
128701 NNNNNNNNNN NNNNNNNNNN NNNNNNNNNN NNNNNNNNNN NNNNNNNNNN
128751 NNNNNNNNNN NNNNNNNNNN NNNNNNNNNN NNNNNNNNNN NNNNNNNNNN
128801 NNNNNNNNNN NNNNNNNNNN NNNNNNNNNN NNNNNNNNNN NNNNNNNNNN
128851 NNNNNNNNNN NNNNNNNNNN NNNNNNNNNN NNNNNNNNNN NNNNNNNNNN
128901 NNNNNNNNNN NNNNNNNNNN NNNNNNNNNN NNNNNNNNNN NNNNNNNNNN
128951 NNNNNNNNNN NNNNNNNNNN NNNNNNNNNN NNNNNNNNNN NNNNNNNNNN
129001 NNNNNNNNNN NNNNNNNNNN NNNNNNNNNN NNNNNNNNNN NNNNNNNNNN
129051 NNNNNNNNNN NNNNNNNNNN NNNNNNNNNN NNNNNNNNNN NNNNNNNNNN
129101 NNNNNNNNNN NNNNNNNNNN NNNNNNNNNN NNNNNNNNNN NNNNNNNNNN
129151 NNNNNNNNNN NNNNNNNNNN NNNNNNNNNN NNNNNNNNNN NNNNNNNNNN

FIGURE 3LL

129201 NNNNNNNNNN NNNNNNNNNN NNNNNNNNNN NNNNNNNNNN NNNNNNNNNN
129251 NNNNNNNNNN NNNNNNNNNN NNNNNNNNNN NNNNNNNNNN NNNNNNNNNN
129301 NNNNNNNNNN NNNNNNNNNN NNNNNNNNNN NNNNNNNNNN NNNNNNNNNN
129351 NNNNNNNNNN NNNNNNNNNN NNNNNNNNNN NNNNNNNNNN NNNNNNNNNN
129401 NNNNNNNNNN NNNNNNNNNN NNNNNNNNNN NNNNNNNNNN NNNNNNNNNN
129451 NNNNNNNNNN NNNNNNNNNN NNNNNNNNNN NNNNNNNNNN NNNNNNNNNN
129501 NNNNNNNNNN NNNNNNNNNN NNNNNNNNNN NNNNNNNNNN NNNNNNNNNN
129551 NNNNNNNNNN NNNNNNNNNN NNNNNNNNNN NNNNNNNNNN NNNNNNNNNN
129601 NNNNNNNNNN NNNNNNNNNN NNNNNNNNNN NNNNNNNNNN NNNNNNNNNN
129651 NNNNNNNNNN NNNNNNNNNN NNNNNNNNNN NNNNNNNNNN NNNNNNNNNN
129701 NNNNNNNNNN NNNNNNNNNN NNNNNNNNNN NNNNNNNNNN NNNNNNNNNN
129751 NNNNNNNNNN NNNNNNNNNN NNNNNNNNNN NNNNNNNNNN NNNNNNNNNN
129801 NNNNNNNNNN NNNNNNNNNN NNNNNNNNNN NNNNNNNNNN NNNNNNNNNN
129851 NNNNNNNNNN NNNNNNNNNN NNNNNNNNNN NNNNNNNNNN NNNNNNNNNN
129901 NNNNNNNNNN NNNNNNNNNN NNNNNNNNNN NNNNNNNNNN NNNNNNNNNN
129951 NNNNNNNNNN NNNNNNNNNN NNNNNNNNNN NNNNNNNNNN NNNNNNNNNN
130001 NNNNNNNNNN NNNNNNNNNN NNNNNNNNNN NNNNNNNNNN NNNNNNNNNN
130051 NNNNNNNNNN NNNNNNNNNN NNNNNNNNNN NNNNNNNNNN NNNNNNNNNN
130101 NNNNNNNNNN NNNNNNNNNN NNNNNNNNNN NNNNNNNNNN NNNNNNNNNN
130151 NNNNNNNNNN NNNNNNNNNN NNNNNNNNNN NNNNNNNNNN NNNNNNNNNN
130201 NNNNNNNNNN NNNNNNNNNN NNNNNNNNNN NNNNNNNNNN NNNNNNNNNN
130251 NNNNNNNNNN NNNNNNNNNN NNNNNNNNNN NNNNNNNNNN NNNNNNNNNN
130301 NNNNNNNNNN NNNNNNNNNN NNNNNNNNNN NNNNNNNNNN NNNNNNNNNN
130351 NNNNNNNNNN NNNNNNNNNN NNNNNNNNNN NNNNNNNNNN NNNNNNNNNN
130401 NNNNNNNNNN NNNNNNNNNN NNNNNNNNNN NNNNNNNNNN NNNNNNNNNN
130451 NNNNNNNNNN NNNNNNNNNN NNNNNNNNNN NNNNNNNNNN NNNNNNNNNN
130501 NNNNNNNNNN NNNNNNNNNN NNNNNNNNNN NNNNNNNNNN NNNNNNNNNN
130551 NNNNNNNNNN NNNNNNNNNN NNNNNNNNNN NNNNNNNNNN NNNNNNNNNN
130601 NNNNNNNNNN NNNNNNNNNN NNNNNNNNNN NNNNNNNNNN NNNNNNNNNN
130651 NNNNNNNNNN NNNNNNNNNN NNNNNNNNNN NNNNNNNNNN NNNNNNNNNN
130701 NNNNNNNNNN NNNNNNNNNN NNNNNNNNNN NNNNNNNNNN NNNNNNNNNN
130751 NNNNNNNNNN NNNNNNNNNN NNNNNNNNNN NNNNNNNNNN NNNNNNNNNN
130801 NNNNNNNNNN NNNNNNNNNN NNNNNNNNNN NNNNNNNNNN NNNNNNNNNN
130851 NNNNNNNNNN NNNNNNNNNN NNNNNNNNNN NNNNNNNNNN NNNNNNNNNN
130901 NNNNNNNNNN NNNNNNNNNN NNNNNNNNNN NNNNNNNNNN NNNNNNNNNN
130951 NNNNNNNNNN NNNNNNNNNN NNNNNNNNNN NNNNNNNNNN NNNNNNNNNN
131001 NNNNNNNNNN NNNNNNNNNN NNNNNNNNNN NNNNNNNNNN NNNNNNNNNN
131051 NNNNNNNNNN NNNNNNNNNN NNNNNNNNNN NNNNNNNNNN NNNNNNNNNN
131101 NNNNNNNNNN NNNNNNNNNN NNNNNNNNNN NNNNNNNNNN NNNNNNNNNN
131151 NNNNNNNNNN NNNNNNNNNN NNNNNNNNNN NNNNNNNNNN NNNNNNNNNN
131201 NNNNNNNNNN NNNNNNNNNN NNNNNNNNNN NNNNNNNNNN NNNNNNNNNN
131251 NNNNNNNNNN NNNNNNNNNN NNNNNNNNNN NNNNNNNNNN NNNNNNNNNN
131301 NNNNNNNNNN NNNNNNNNNN NNNNNNNNNN NNNNNNNNNN NNNNNNNNNN
131351 NNNNNNNNNN NNNNNNNNNN NNNNNNNNNN NNNNNNNNNN NNNNNNNNNN
131401 NNNNNNNNNN NNNNNNNNNN NNNNNNNNNN NNNNNNNNNN NNNNNNNNNN
131451 NNNNNNNNNN NNNNNNNNNN NNNNNNNNNN NNNNNNNNNN NNNNNNNNNN
131501 NNNNNNNNNN NNNNNNNNNN NNNNNNNNNN NNNNNNNNNN NNNNNNNNNN
131551 NNNNNNNNNN NNNNNNNNNN NNNNNNNNNN NNNNNNNNNN NNNNNNNNNN
131601 NNNNNNNNNN NNNNNNNNNN NNNNNNNNNN NNNNNNNNNN NNNNNNNNNN
131651 NNNNNNNNNN NNNNNNNNNN NNNNNNNNNN NNNNNNNNNN NNNNNNNNNN
131701 NNNNNNNNNN NNNNNNNNNN NNNNNNNNNN NNNNNNNNNN NNNNNNNNNN
131751 NNNNNNNNNN NNNNNNNNNN NNNNNNNNNN NNNNNNNNNN NNNNNNNNNN
131801 NNNNNNNNNN NNNNNNNNNN NNNNNNNNNN NNNNNNNNNN NNNNNNNNNN
131851 NNNNNNNNNN NNNNNNNNNN NNNNNNNNNN NNNNNNNNNN NNNNNNNNNN
131901 NNNNNNNNNN NNNNNNNNNN NNNNNNNNNN NNNNNNNNNN NNNNNNNNNN
131951 NNNNNNNNNN NNNNNNNNNN NNNNNNNNNN NNNNNNNNNN NNNNNNNNNN
132001 NNNNNNNNNN NNNNNNNNNN NNNNNNNNNN NNNNNNNNNN NNNNNNNNNN
132051 NNNNNNNNNN NNNNNNNNNN NNNNNNNNNN NNNNNNNNNN NNNNNNNNNN
132101 NNNNNNNNNN NNNNNNNNNN NNNNNNNNNN NNNNNNNNNN NNNNNNNNNN
132151 NNNNNNNNNN NNNNNNNNNN NNNNNNNNNN NNNNNNNNNN NNNNNNNNNN
132201 NNNNNNNNNN NNNNNNNNNN NNNNNNNNNN NNNNNNNNNN NNNNNNNNNN
132251 NNNNNNNNNN NNNNNNNNNN NNNNNNNNNN NNNNNNNNNN NNNNNNNNNN
132301 NNNNNNNNNN NNNNNNNNNN NNNNNNNNNN NNNNNNNNNN NNNNNNNNNN
132351 NNNNNNNNNN NNNNNNNNNN NNNNNNNNNN NNNNNNNNNN NNNNNNNNNN
132401 NNNNNNNNNN NNNNNNNNNN NNNNNNNNNN NNNNNNNNNN NNNNNNNNNN
132451 NNNNNNNNNN NNNNNNNNNN NNNNNNNNNN NNNNNNNNNN NNNNNNNNNN
132501 NNNNNNNNNN NNNNNNNNNN NNNNNNNNNN NNNNNNNNNN NNNNNNNNNN
132551 NNNNNNNNNN NNNNNNNNNN NNNNNNNNNN NNNNNNNNNN NNNNNNNNNN

FIGURE 3MM

132601 NNNNNNNNNN NNNNNNNNNN NNNNNNNNNN NNNNNNNNNN NNNNNNNNNN
132651 NNNNNNNNNN NNNNNNNNNN NNNNNNNNNN NNNNNNNNNN NNNNNNNNNN
132701 NNNNNNNNNN NNNNNNNNNN NNNNNNNNNN NNNNNNNNNN NNNNNNNNNN
132751 NNNNNNNNNN NNNNNNNNNN NNNNNNNNNN NNNNNNNNNN NNNNNNNNNN
132801 NNNNNNNNNN NNNNNNNNNN NNNNNNNNNN NNNNNNNNNN NNNNNNNNNN
132851 NNNNNNNNNN NNNNNNNNNN NNNNNNNNNN NNNNNNNNNN NNNNNNNNNN
132901 NNNNNNNNNN NNNNNNNNNN NNNNNNNNNN NNNNNNNNNN NNNNNNNNNN
132951 NNNNNNNNNN NNNNNNNNNN NNNNNNNNNN NNNNNNNNNN NNNNNNNNNN
133001 NNNNNNNNNN NNNNNNNNNN NNNNNNNNNN NNNNNNNNNN NNNNNNNNNN
133051 NNNNNNNNNN NNNNNNNNNN NNNNNNNNNN NNNNNNNNNN NNNNNNNNNN
133101 NNNNNNNNNN NNNNNNNNNN NNNNNNNNNN NNNNNNNNNN NNNNNNNNNN
133151 NNNNNNNNNN NNNNNNNNNN NNNNNNNNNN NNNNNNNNNN NNNNNNNNNN
133201 NNNNNNNNNN NNNNNNNNNN NNNNNNNNNN NNNNNNNNNN NNNNNNNNNN
133251 NNNNNNNNNN NNNNNNNNNN NNNNNNNNNN NNNNNNNNNN NNNNNNNNNN
133301 NNNNNNNNNN NNNNNNNNNN NNNNNNNNNN NNNNNNNNNN NNNNNNNNNN
133351 NNNNNNNNNN NNNNNNNNNN NNNNNNNNNN NNNNNNNNNN NNNNNNNNNN
133401 NNNNNNNNNN NNNNNNNNNN NNNNNNNNNN NNNNNNNNNN NNNNNNNNNN
133451 NNNNNNNNNN NNNNNNNNNN NNNNNNNNNN NNNNNNNNNN NNNNNNNNNN
133501 NNNNNNNNNN NNNNNNNNNN NNNNNNNNNN NNNNNNNNNN NNNNNNNNNN
133551 NNNNNNNNNN NNNNNNNNNN NNNNNNNNNN NNNNNNNNNN NNNNNNNNNN
133601 NNNNNNNNNN NNNNNNNNNN NNNNNNNNNN NNNNNNNNNN NNNNNNNNNN
133651 NNNNNNNNNN NNNNNNNNNN NNNNNNNNNN NNNNNNNNNN NNNNNNNNNN
133701 NNNNNNNNNN NNNNNNNNNN NNNNNNNNNN NNNNNNNNNN NNNNNNNNNN
133751 NNNNNNNNNN NNNNNNNNNN NNNNNNNNNN NNNNNNNNNN NNNNNNNNNN
133801 NNNNNNNNNN NNNNNNNNNN NNNNNNNNNN NNNNNNNNNN NNNNNNNNNN
133851 NNNNNNNNNN NNNNNNNNNN NNNNNNNNNN NNNNNNNNNN NNNNNNNNNN
133901 NNNNNNNNNN NNNNNNNNNN NNNNNNNNNN NNNNNNNNNN NNNNNNNNNN
133951 NNNNNNNNNN NNNNNNNNNN NNNNNNNNNN NNNNNNNNNN NNNNNNNNNN
134001 NNNNNNNNNN NNNNNNNNNN NNNNNNNNNN NNNNNNNNNN NNNNNNNNNN
134051 NNNNNNNNNN NNNNNNNNNN NNNNNNNNNN NNNNNNNNNN NNNNNNNNNN
134101 NNNNNNNNNN NNNNNNNNNN NNNNNNNNNN NNNNNNNNNN NNNNNNNNNN
134151 NNNNNNNNNN NNNNNNNNNN NNNNNNNNNN NNNNNNNNNN NNNNNNNNNN
134201 NNNNNNNNNN NNNNNNNNNN NNNNNNNNNN NNNNNNNNNN NNNNNNNNNN
134251 NNNNNNNNNN NNNNNNNNNN NNNNNNNNNN NNNNNNNNNN NNNNNNNNNN
134301 NNNNNNNNNN NNNNNNNNNN NNNNNNNNNN NNNNNNNNNN NNNNNNNNNN
134351 NNNNNNNNNN NNNNNNNNNN NNNNNNNNNN NNNNNNNNNN NNNNNNNNNN
134401 NNNNNNNNNN NNNNNNNNNN NNNNNNNNNN NNNNNNNNNN NNNNNNNNNN
134451 NNNNNNNNNN NNNNNNNNNN NNNNNNNNNN NNNNNNNNNN NNNNNNNNNN
134501 NNNNNNNNNN NNNNNNNNNN NNNNNNNNNN NNNNNNNNNN NNNNNNNNNN
134551 NNNNNNNNNN NNNNNNNNNN NNNNNNNNNN NNNNNNNNNN NNNNNNNNNN
134601 NNNNNNNNNN NNNNNNNNNN NNNNNNNNNN NNNNNNNNNN NNNNNNNNNN
134651 NNNNNNNNNN NNNNNNNNNN NNNNNNNNNN NNNNNNNNNN NNNNNNNNNN
134701 NNNNNNNNNN NNNNNNNNNN NNNNNNNNNN NNNNNNNNNN NNNNNNNNNN
134751 NNNNNNNNNN NNNNNNNNNN NNNNNNNNNN NNNNNNNNNN NNNNNNNNNN
134801 NNNNNNNNNN NNNNNNNNNN NNNNNNNNNN NNNNNNNNNN NNNNNNNNNN
134851 NNNNNNNNNN NNNNNNNNNN NNNNNNNNNN NNNNNNNNNN NNNNNNNNNN
134901 NNNNNNNNNN NNNNNNNNNN NNNNNNNNNN NNNNNNNNNN NNNNNNNNNN
134951 NNNNNNNNNN NNNNNNNNNN NNNNNNNNNN NNNNNNNNNN NNNNNNNNNN
135001 NNNNNNNNNN NNNNNNNNNN NNNNNNNNNN NNNNNNNNNN NNNNNNNNNN
135051 NNNNNNNNNN NNNNNNNNNN NNNNNNNNNN NNNNNNNNNN NNNNNNNNNN
135101 NNNNNNNNNN NNNNNNNNNN NNNNNNNNNN NNNNNNNNNN NNNNNNNNNN
135151 NNNNNNNNNN NNNNNNNNNN NNNNNNNNNN NNNNNNNNNN NNNNNNNNNN
135201 NNNNNNNNNN NNNNNNNNNN NNNNNNNNNN NNNNNNNNNN NNNNNNNNNN
135251 NNNNNNNNNN NNNNNNNNNN NNNNNNNNNN NNNNNNNNNN NNNNNNNNNN
135301 NNNNNNNNNN NNNNNNNNNN NNNNNNNNNN NNNNNNNNNN NNNNNNNNNN
135351 NNNNNNNNNN NNNNNNNNNN NNNNNNNNNN NNNNNNNNNN NNNNNNNNNN
135401 NNNNNNNNNN NNNNNNNNNN NNNNNNNNNN NNNNNNNNNN NNNNNNNNNN
135451 NNNNNNNNNN NNNNNNNNNN NNNNNNNNNN NNNNNNNNNN NNNNNNNNNN
135501 NNNNNNNNNN NNNNNNNNNN NNNNNNNNNN NNNNNNNNNN NNNNNNNNNN
135551 NNNNNNNNNN NNNNNNNNNN NNNNNNNNNN NNNNNNNNNN NNNNNNNNNN
135601 NNNNNNNNNN NNNNNNNNNN NNNNNNNNNN NNNNNNNNNN NNNNNNNNNN
135651 NNNNNNNNNN NNNNNNNNNN NNNNNNNNNN NNNNNNNNNN NNNNNNNNNN
135701 NNNNNNNNNN NNNNNNNNNN NNNNNNNNNN NNNNNNNNNN NNNNNNNNNN
135751 NNNNNNNNNN NNNNNNNNNN NNNNNNNNNN NNNNNNNNNN NNNNNNNNNN
135801 NNNNNNNNNN NNNNNNNNNN NNNNNNNNNN NNNNNNNNNN NNNNNNNNNN
135851 NNNNNNNNNN NNNNNNNNNN NNNNNNNNNN NNNNNNNNNN NNNNNNNNNN
135901 NNNNNNNNNN NNNNNNNNNN NNNNNNNNNN NNNNNNNNNN NNNNNNNNNN
135951 NNNNNNNNNN NNNNNNNNNN NNNNNNNNNN NNNNNNNNNN NNNNNNNNNN

FIGURE 3NN

136001 NNNNNNNNNN NNNNNNNNNN NNNNNNNNNN NNNNNNNNNN NNNNNNNNNN
136051 NNNNNNNNNN NNNNNNNNNN NNNNNNNNNN NNNNNNNNNN NNNNNNNNNN
136101 NNNNNNNNNN NNNNNNNNNN NNNNNNNNNN NNNNNNNNNN NNNNNNNNNN
136151 NNNNNNNNNN NNNNNNNNNN NNNNNNNNNN NNNNNNNNNN NNNNNNNNNN
136201 NNNNNNNNNN NNNNNNNNNN NNNNNNNNNN NNNNNNNNNN NNNNNNNNNN
136251 NNNNNNNNNN NNNNNNNNNN NNNNNNNNNN NNNNNNNNNN NNNNNNNNNN
136301 NNNNNNNNNN NNNNNNNNNN NNNNNNNNNN NNNNNNNNNN NNNNNNNNNN
136351 NNNNNNNNNN NNNNNNNNNN NNNNNNNNNN NNNNNNNNNN NNNNNNNNNN
136401 NNNNNNNNNN NNNNNNNNNN NNNNNNNNNN NNNNNNNNNN NNNNNNNNNN
136451 NNNNNNNNNN NNNNNNNNNN NNNNNNNNNN NNNNNNNNNN NNNNNNNNNN
136501 NNNNNNNNNN NNNNNNNNNN NNNNNNNNNN NNNNNNNNNN NNNNNNNNNN
136551 NNNNNNNNNN NNNNNNNNNN NNNNNNNNNN NNNNNNNNNN NNNNNNNNNN
136601 NNNNNNNNNN NNNNNNNNNN NNNNNNNNNN NNNNNNNNNN NNNNNNNNNN
136651 NNNNNNNNNN NNNNNNNNNN NNNNNNNNNN NNNNNNNNNN NNNNNNNNNN
136701 NNNNNNNNNN NNNNNNNNNN NNNNNNNNNN NNNNNNNNNN NNNNNNNNNN
136751 NNNNNNNNNN NNNNNNNNNN NNNNNNNNNN NNNNNNNNNN NNNNNNNNNN
136801 NNNNNNNNNN NNNNNNNNNN NNNNNNNNNN NNNNNNNNNN NNNNNNNNNN
136851 NNNNNNNNNN NNNNNNNNNN NNNNNNNNNN NNNNNNNNNN NNNNNNNNNN
136901 NNNNNNNNNN NNNNNNNNNN NNNNNNNNNN NNNNNNNNNN NNNNNNNNNN
136951 NNNNNNNNNN NNNNNNNNNN NNNNNNNNNN NNNNNNNNNN NNNNNNNNNN
137001 NNNNNNNNNN NNNNNNNNNN NNNNNNNNNN NNNNNNNNNN NNNNNNNNNN
137051 NNNNNNNNNN NNNNNNNNNN NNNNNNNNNN NNNNNNNNNN NNNNNNNNNN
137101 NNNNNNNNNN NNNNNNNNNN NNNNNNNNNN NNNNNNNNNN NNNNNNNNNN
137151 NNNNNNNNNN NNNNNNNNNN NNNNNNNNNN NNNNNNNNNN NNNNNNNNNN
137201 NNNNNNNNNN NNNNNNNNNN NNNNNNNNNN NNNNNNNNNN NNNNNNNNNN
137251 NNNNNNNNNN NNNNNNNNNN NNNNNNNNNN NNNNNNNNNN NNNNNNNNNN
137301 NNNNNNNNNN NNNNNNNNNN NNNNNNNNNN NNNNNNNNNN NNNNNNNNNN
137351 NNNNNNNNNN NNNNNNNNNN NNNNNNNNNN NNNNNNNNNN NNNNNNNNNN
137401 NNNNNNNNNN NNNNNNNNNN NNNNNNNNNN NNNNNNNNNN NNNNNNNNNN
137451 NNNNNNNNNN NNNNNNNNNN NNNNNNNNNN NNNNNNNNNN NNNNNNNNNN
137501 NNNNNNNNNN NNNNNNNNNN NNNNNNNNNN NNNNNNNNNN NNNNNNNNNN
137551 NNNNNNNNNN NNNNNNNNNN NNNNNNNNNN NNNNNNNNNN NNNNNNNNNN
137601 NNNNNNNNNN NNNNNNNNNN NNNNNNNNNN NNNNNNNNNN NNNNNNNNNN
137651 NNNNNNNNNN NNNNNNNNNN NNNNNNNNNN NNNNNNNNNN NNNNNNNNNN
137701 NNNNNNNNNN NNNNNNNNNN NNNNNNNNNN NNNNNNNNNN NNNNNNNNNN
137751 NNNNNNNNNN NNNNNNNNNN NNNNNNNNNN NNNNNNNNNN NNNNNNNNNN
137801 NNNNNNNNNN NNNNNNNNNN NNNNNNNNNN NNNNNNNNNN NNNNNNNNNN
137851 NNNNNNNNNN NNNNNNNNNN NNNNNNNNNN NNNNNNNNNN NNNNNNNNNN
137901 NNNNNNNNNN NNNNNNNNNN NNNNNNNNNN NNNNNNNNNN NNNNNNNNNN
137951 NNNNNNNNNN NNNNNNNNNN NNNNNNNNNN NNNNNNNNNN NNNNNNNNNN
138001 NNNNNNNNNN NNNNNNNNNN NNNNNNNNNN NNNNNNNNNN NNNNNNNNNN
138051 NNNNNNNNNN NNNNNNNNNN NNNNNNNNNN NNNNNNNNNN NNNNNNNNNN
138101 NNNNNNNNNN NNNNNNNNNN NNNNNNNNNN NNNNNNNNNN NNNNNNNNNN
138151 NNNNNNNNNN NNNNNNNNNN NNNNNNNNNN NNNNNNNNNN NNNNNNNNNN
138201 NNNNNNNNNN NNNNNNNNNN NNNNNNNNNN NNNNNNNNNN NNNNNNNNNN
138251 NNNNNNNNNN NNNNNNNNNN NNNNNNNNNN NNNNNNNNNN NNNNNNNNNN
138301 NNNNNNNNNN NNNNNNNNNN NNNNNNNNNN NNNNNNNNNN NNNNNNNNNN
138351 NNNNNNNNNN NNNNNNNNNN NNNNNNNNNN NNNNNNNNNN NNNNNNNNNN
138401 NNNNNNNNNN NNNNNNNNNN NNNNNNNNNN NNNNNNNNNN NNNNNNNNNN
138451 NNNNNNNNNN NNNNNNNNNN NNNNNNNNNN NNNNNNNNNN NNNNNNNNNN
138501 NNNNNNNNNN NNNNNNNNNN NNNNNNNNNN NNNNNNNNNN NNNNNNNNNN
138551 NNNNNNNNNN NNNNNNNNNN NNNNNNNNNN NNNNNNNNNN NNNNNNNNNN
138601 NNNNNNNNNN NNNNNNNNNN NNNNNNNNNN NNNNNNNNNN NNNNNNNNNN
138651 NNNNNNNNNN NNNNNNNNNN NNNNNNNNNN NNNNNNNNNN NNNNNNNNNN
138701 NNNNNNNNNN NNNNNNNNNN NNNNNNNNNN NNNNNNNNNN NNNNNNNNNN
138751 NNNNNNNNNN NNNNNNNNNN NNNNNNNNNN NNNNNNNNNN NNNNNNNNNN
138801 NNNNNNNNNN NNNNNNNNNN NNNNNNNNNN NNNNNNNNNN NNNNNNNNNN
138851 NNNNNNNNNN NNNNNNNNNN NNNNNNNNNN NNNNNNNNNN NNNNNNNNNN
138901 NNNNNNNNNN NNNNNNNNNN NNNNNNNNNN NNNNNNNNNN NNNNNNNNNN
138951 NNNNNNNNNN NNNNNNNNNN NNNNNNNNNN NNNNNNNNNN NNNNNNNNNN
139001 NNNNNNNNNN NNNNNNNNNN NNNNNNNNNN NNNNNNNNNN NNNNNNNNNN
139051 NNNNNNNNNN NNNNNNNNNN NNNNNNNNNN NNNNNNNNNN NNNNNNNNNN
139101 NNNNNNNNNN NNNNNNNNNN NNNNNNNNNN NNNNNNNNNN NNNNNNNNNN
139151 NNNNNNNNNN NNNNNNNNNN NNNNNNNNNN NNNNNNNNNN NNNNNNNNNN
139201 NNNNNNNNNN NNNNNNNNNN NNNNNNNNNN NNNNNNNNNN NNNNNNNNNN
139251 NNNNNNNNNN NNNNNNNNNN NNNNNNNNNN NNNNNNNNNN NNNNNNNNNN
139301 NNNNNNNNNN NNNNNNNNNN NNNNNNNNNN NNNNNNNNNN NNNNNNNNNN
139351 NNNNNNNNNN NNNNNNNNNN NNNNNNNNNN NNNNNNNNNN NNNNNNNNNN

FIGURE 3OO

139401 NNNNNNNNNN NNNNNNNNNN NNNNNNNNNN NNNNNNNNNN NNNNNNNNNN
139451 NNNNNNNNNN NNNNNNNNNN NNNNNNNNNN NNNNNNNNNN NNNNNNNNNN
139501 NNNNNNNNNN NNNNNNNNNN NNNNNNNNNN NNNNNNNNNN NNNNNNNNNN
139551 NNNNNNNNNN NNNNNNNNNN NNNNNNNNNN NNNNNNNNNN NNNNNNNNNN
139601 NNNNNNNNNN NNNNNNNNNN NNNNNNNNNN NNNNNNNNNN NNNNNNNNNN
139651 NNNNNNNNNN NNNNNNNNNN NNNNNNNNNN NNNNNNNNNN NNNNNNNNNN
139701 NNNNNNNNNN NNNNNNNNNN NNNNNNNNNN NNNNNNNNNN NNNNNNNNNN
139751 NNNNNNNNNN NNNNNNNNNN NNNNNNNNNN NNNNNNNNNN NNNNNNNNNN
139801 NNNNNNNNNN NNNNNNNNNN NNNNNNNNNN NNNNNNNNNN NNNNNNNNNN
139851 NNNNNNNNNN NNNNNNNNNN NNNNNNNNNN NNNNNNNNNN NNNNNNNNNN
139901 NNNNNNNNNN NNNNNNNNNN NNNNNNNNNN NNNNNNNNNN NNNNNNNNNN
139951 NNNNNNNNNN NNNNNNNNNN NNNNNNNNNN NNNNNNNNNN NNNNNNNNNN
140001 NNNNNNNNNN NNNNNNNNNN NNNNCCATTC ACAATTGCTT CAAAGAGAAT
140051 AAAATACCTG GGTAATCTAA CTTACAAGGG ATGTGAAGGA GCTCTTCAAG
140101 GAGAACTACA AACCACTGCT CAATGAAATA AAAGAGGATA CAAACAAATG
140151 GAAGAACATT CCATGCTCAT GGATAGGAAG AATCAATATC ATGAAAATGG
140201 CCATACTGCC CAAGGTAACT TATAGATTCA ATGCCATCCC CATCAAGCTA
140251 CCAATGACTT TCTTCACAGA ATTGGAAAAA ACTACTTTAA AGTTCATATA
140301 GACCCGAAAG AGAGCCTGCA TTGCCAAGAC AGTCCTAAGC CAAAAGAACA
140351 AAGCTGGAGG CATCACGCTA CCTGACTTGA AACTACACTA CAGGGCTACG
140401 ATAGCTCATT TCTTTTTAGT ACTGAATAAT ATTCTGTTGT GGATGTACCT
140451 GGGATTTTTG AAAATGGTAT CCTGTACGTA TTTTGGATAT TTTCCCCAAC
140501 TATTTTTAAA TAAGTATGAA GGCAAAAACT GTTTTTTTAA TTGCACTTTG
140551 GCAAAGTTTA TCTTTGCAAG ACTCTTAAAA TGGATATAGT CATCTAAAAC
140601 TTGGAGTGTC TTATAGATCA GTTGTTTTCA TATATACTTT ATTTGCTTCT
140651 GTATGTTCTA TGTGTCATTG AGGAAAATTT CTATCATTTC TTGTCAACTA
140701 CCACATAAAG TTGATTGTGA TTCCTCCACC CATATTCCTT TACAGTTCAT
140751 ATGTAACCTT GGCATAATTT TGGCTGTTTT GAAACTTAGG AATCAGTGCA
140801 TTGTTTAAGC TGTAGGAAGA TATCTTAGTA ATTCTTATTG ATGTTACTTT
140851 TTATTTCCCT GAAAGTCAGG AGAAGGAATA TTAGATATGT TTTTGAATAA
140901 GCCAGCTTTA TGGAAAAAAA ATGCTAAGTA TTTAAAATGT AATTACACTT
140951 TGATTAAAAT AAATGAATAA AATCTTATTA TATAGATTCG TGGTAAAAGG
141001 AAAGTCTTTA TATTTGATTA GTGGTGTTTC CTCTATCTTC AGGTATGCCT
141051 CCTTTCACCA CAAGCTCAAG ACTCAAGAAA TTTGTACGTA TATAGCAGAT
141101 CTAAGATAAA TGAAAATCTG GTCGCAGTTC TATTTATCAA ACAAAACACC
141151 TATACCTAAT TGTCAAGATT GTTTGCTAAG TAAAAATTAA TCTGTATTGA
141201 TGTACCAGAG AATTGGAATA AGGTACAAAA GACTAAAGGG CACCAGAAAA
141251 GATGGATTGC TTGAACTGAG ATTGGCTTTA CTCACACTGC AATGTGTCTT
141301 TTGACTGTGT GCATCCTAAG TTGTGAGTGA CTGGGACATT TGGAGGTTAT
141351 GCCGTGGAGT CCTGCTATGC TGTTGACCAT CACCATGTAT GGTGTTTTGT
141401 TGTATGCCGT ATATCCCTTT TCATAATGCT CAATAAAATT GGTGTTGGAT
141451 GAATCCTATT GTCTGTTGCA CTTGATTGCT AAATCAAACC CAAGAACATT
141501 GCTACAGTTT TACAAGTGTA CATCAGGTCG AAAATAAATG AGAATCTGGC
141551 CCAGTTACTG ATTGATAGAC GGAGAAAAAA TTGTAAGTTT TTTTTCACTT
141601 GTTTTGAATT TAATTCTAAT ACAAAATTTA ACTTAAATCT TAAAAACAAA
141651 AAATATTACA TGAAACAAAA ATAGCTATTA GTAGCAAAAG GTGTGCAGCA
141701 TATAAAAAGG CAGTATAAAT CTAGCTGTTG AAAGATGGGC TGGGAATTCA
141751 AAATTTTGCA GTATTACTTA TTAGCTGTGT GATTTGGGCC ATGTTACCTA
141801 ACCACTCTAT GCCTCAGTTT CTTTATTTGT AAAGTTAGGT TAATAATAAT
141851 TAATGACATG ATGGGACTTT TTGAGAATAA AGTGAGATTT TTATAAAAAG
141901 TATATATATA ACATTGCTGT GTAAAGTTAT CTATTAGCAC ATGAAATTAA
141951 ACCTCTCTAA ATAATAAGGA TTGTAAGCAG GTGATGTAGG ATTACAATGG
142001 GTAATAAATG ACTAATATTA AAAGGTAGGC AATGTGTGTG GGGAATTTAT
142051 TTTATTCCTT AAATACTTGA CTAAATGCAA ATACATTTTA AAATCATATT
142101 TATTTCTCTA ACTTCTATTT AAATGTCAGT ATTTTTACCA CTTTCTTCTC
142151 TGCTTTTCCT CTACTGCTTA AACTTACTCT CTCTAGGACA TCTCATTTAT
142201 GGCTACCATG ACCTTAGAAG GTTAAATACT TATCAAAATA TGTTCTGTAG
142251 CCCAGACTTT TTCCTGAGGA CCAGCACCAT TTTCCTAATT GACTACCGAA
142301 AATTAAAGTC TTAACATTAA ACCTTTTGTG TTCACAAGTT CAACATTCAT
142351 AGCTTTGAAG TCTTTGTGTC CTTACTTTTC CTTAAAATTT ATCCTTCTGT
142401 GCAGTGTCTT CTAACAAATA AAGTTCTATT CAGGGAGACC TTACTTTTAA
142451 AACTTCCATT AACTTGTCAT TATCTCAAAT TACTGTGTTT AGCAGACATT
142501 AAAGGATCTT GGAAACATGG TGTGTGTCAC TTTCCCAGCT TCATATTTCA
142551 TCTTTCCCCA TTAGTCTAAT GTTCCAACCA CAATGCCCGT CTTAGCATCT
142601 CGTAATTTCT CATGTGCTTC TGTATACCTA TTAGAGGTTC TCTCATTCTC
142651 TAGTTCTTGG ATTGTCCAAG ACTACTCATG CCCTAGTTCA AATACTAATG
142701 CCATGCCCTC ACCTATAAAG TGTAGGACCT CTTAGGCAGA GACTGTGCCC
142751 CTGTAACACC CTTTGCACAA TACTGGTATA CTGGTGTAAG CCTCTTTGCC

FIGURE 3PP

142801 CTTGATGTTC TGAAAGATAC TGAGTTGCAT TTCTCTCTCT CATGAGGTTG
142851 CAGCTTTGTG AAGTCAGGAA CTGTGTCTTT TTCTCAGTTA TAATATATTA
142901 GTTCATGGAA AAATCACTGT ATTGGATTTT TAAAGTTGAA CCAATGAAAC
142951 AATTAAGCAA TGGAAGTTGA AGAGAAATAA ATCATCATTA TTCATGGGTG
143001 GTAATCTTCC AAAGATACTC TTTTGCTTAA TATCTAATTA TTTGTTAACT
143051 CTTGAGCCTC CTGATTCTAT AAAATTATTT TTGAGTGTTG CTATTGTAGT
143101 GTATATGTCC AAGTTCAACT TCATCCACTT TTTATTACTG TTTGTATTTA
143151 TATTGCTATA TACACATCAT AATTGCCTTT TCCATGTTGA TATGCCAGTT
143201 TTTTACTAGT GTCTATTATG TCTACCTAGA TCTTCATTAT TGAACATTTA
143251 AATGTTTTTT ATTGGAATTT GTTATCTAAG AGAATTAGTG ATGGCTAATC
143301 ATAATTTTCT TCTCATTTAA CCCAGCTTTT TCTTTTATTC TTTTTCTGTT
143351 TATTGTTTAT GAATTATATT TAGTGTTGAC TTCTTTGCTT TTTTTTTACT
143401 TAGTTAAGAA CTGATATTCA GCGTTGGCAG TGGAATTATG ATAGTAAAAA
143451 TAATTCTTAT TCCTTAGTTG CTTCACTGTT ACAGATTTTA TTTTCAAGAA
143501 AAGAATAATT GAGAAACTGT CTAGTAGAAA GTAGGTTTTC TCCAGCATGG
143551 TCAGTAATAT TCTGCCAACC AGAGACTAGC CCATAGTCTA TACTTTTTTA
143601 TACTGTATTA CTTTTTACCT ATCACTTGAT TTAATTCTTT GTTCTAACAT
143651 ACTTTATACC ATATTAGTGA CATAAAGAAA TCAAAATATG CCTTTGTTAA
143701 GTTTTTTATT TTTGTATTGA AGATAAAGTT ATTTAATCAA TCAGTAGCAT
143751 TTATAAAGTA ATCATTACTA ACAACTCAGT TATTATTGCC TCCTAACTAA
143801 AAAGGCACGT AACTCTTTGC TAAGAGAATT CAAGTATTTG AGAGACAATC
143851 TTTGACATCA AGATGCTGAT GATATATTTT CTATTAAGAA TATAAACTCT
143901 ATAAATCATC ATCATCATCA TAATTCTGGT TTACTAGTAT CTTATTTTAT
143951 AGTTTATTAA TTATCTTCAC TTGTGGAGAT ATGTCATAAC ATCTTCATAA
144001 TAACTCGAGG GAGCCATATT ATGTCCTTTA TGGTCCAATA TAGACCTGAA
144051 AATCAGATAA ATTTAAGCAA CTAATCTGAT TTTTATACAA ATCAGAGTGC
144101 CGAGGCTGTG GATTAAATCA TATCTTTTGA TTGAAATGTC CAAGTTATAT
144151 TATGCAGTTT CTTCTTTATT TATAAAACCA GAGGACAATA CACTATAGAG
144201 TATGTTATTT ATGCAAACTG AATATCTTAG GTCATATATT ATAGCAGTTG
144251 AGAGAAAGAA GCTATCTCTG TGGCCTGCAG TAGTCATGAA AATTAGCATG
144301 GTCTCCAGGA AGGAAGAAAG ATAGGAGTTA AGGAGTTGAC TTACTGTTTC
144351 TCAGCAACCT AGGAAACTAT GGTGTACTTG GTTTGATATA AGGACAGACT
144401 AGGTGGGTAT ACTTAATCTT GACAGTCAAG GTTCTTGGAA AATTTAATTA
144451 TTTCTCATCA CTCAGCCTGG GTACTTGTCC TCTTGTTCTC CATTGTACTA
144501 GGAAGAGACC ATCATCATTC AGCATTCCTC ACTACACCCA TCCAGACAAG
144551 AAGGTGAGCT ACTTGTGGTC TGACGCGTGT TAAATAGCTT GATAAGCACT
144601 GCCTAGTACA GTGCCTAGCA CCGAATAGCT GTTTTCTAAA CTTACTTTCT
144651 GCTATAGTTT GGATGTGTCT TGTTCCCACT GAAACTCATG TTGCAATGTA
144701 ATTGCCAATG TAATGGTATT GTGAGGTGGT AGGGCCTTTA AGAGGTGTTT
144751 GGATCGTGAA GGCTTTACCC TCATGAAGGG TTTAGTGCAG TTCTCACAGG
144801 GCTAGGTTAG TTCTTGTGGT GCTGAGTTAG TTCTTGTGAG AGTAGGTTAT
144851 TATAAAGAGG TTTGGCCCTC TTCGTTTCTC TTTTGCTTGT GCTTCTTGCC
144901 TTTCTGCCAT GTTATAACTC AGTATGAAAG ATTTTACCAG ATGTTGCTTC
144951 CATGCTCCAA AATTGTGAGC AAAATAAAGT TATTTTCTTA TAAATTATCC
145001 TGTCTCAATA TTGTTATAGC AACTGAAAAT GGACTTTCTG TTACCCAGTG
145051 TTAACATTAT TTGACCTTTG CCAGATGCAT AGTTTGCAAA AGTTTTCTCC
145101 CATTTTGTAG GTTGTCTATT TACTCGGTTG ATAGTTTCTT TTGACGGGAA
145151 ATCAAATACT GCATGTTGTC ACTTACAATT GGGAGCAAAA TGATAAGAAC
145201 ACATGGACAC ATAGAGGGGA ACAACACTGT AGTATGCCAC AGTGTCTGTC
145251 TGTGGAGGGT GGGAGGAGGG AGAGGATTAG GAAAAACAAC TAAAGGGTAT
145301 TAGGCTTAAT ACCTGNNNNN NNNNNNNNNN NNNNNNNNNN NNNNNNNNNN
145351 NNNNNNNNNN NNNNNNNNNN NNNNNNNNNN NNNNNNNNNN NNNNNNNNNN
145401 NNNNNNNNNN NNNNNNNNNN NNNNNNNNNN NNNNNNNNNN NNNNNNNNNN
145451 NNNNNNNNNN NNNNNNNNNN NNNNNNNNNN NNNNNNNNNN NNNNNNNNNN
145501 NNNNNNNNNN NNNNNNNNNN NNNNNNNNNN NNNNNNNNNN NNNNNNNNNN
145551 NNNNNNNNNN NNNNNNNNNN NNNNNNNNNN NNNNNNNNNN NNNNNNNNNN
145601 NNNNNNNNNN NNNNNNNNNN NNNNNNNNNN NNNNNNNNNN NNNNNNNNNN
145651 NNNNNNNNNN NNNNNNNNNN NNNNNNNNNN NNNNNNNNNN NNNNNNNNNN
145701 NNNNNNNNNN NNNNNNNNNN NNNNNNNNNN NNNNNNNNNN NNNNNNNNNN
145751 NNNNNNNNNN NNNNNNNNNN NNNNNNNNNN NNNNNNNNNN NNNNNNNNNN
145801 NNNNNNNNNN NNNNNNNNNN NNNNNNNNNN NNNNNNNNNN NNNNNNNNNN
145851 NNNNNNNNNN NNNNNNNNNN NNNNNNNNNN NNNNNNNNNN NNNNNNNNNN
145901 NNNNNNNNNN NNNNNNNNNN NNNNNNNNNN NNNNNNNNNN NNNNNNNNNN
145951 NNNNNNNNNN NNNNNNNNNN NNNNNNNNNN NNNNNNNNNN NNNNNNNNNN
146001 NNNNNNNNNN NNNNNNNNNN NNNNNNNNNN NNNNNNNNNN NNNNNNNNNN
146051 NNNNNNNNNN NNNNNNNNNN NNNNNNNNNN NNNNNNNNNN NNNNNNNNNN
146101 NNNNNNNNNN NNNNNNNNNN NNNNNNNNNN NNNNNNNNNN NNNNNNNNNN
146151 NNNNNNNNNN NNNNNNNNNN NNNNNNNNNN NNNNNNNNNN NNNNNNNNNN

FIGURE 3QQ

```
146201 NNNNNNNNNN NNNNNNNNNN NNNNNNNNNN NNNNNNNNNN NNNNNNNNNN
146251 NNNNNNNNNN NNNNNNNNNN NNNNNNNNNN NNNNNNNNNN NNNNNNNNNN
146301 NNNNNNNNNN NNNNNNNNNN NNNNNNNNNN NNNNNNNNNN NNNNNNNNNN
146351 NNNNNNNNNN NNNNNNNNNN NNNNNNNNNN NNNNNNNNNN NNNNNNNNNN
146401 NNNNNNNNNN NNNNNNNNNN NNNNNNNNNN NNNNNNNNNN NNNNNNNNNN
146451 NNNNNNNNNN NNNNNNNNNN NNNNNNNNNN NNNNNNNNNN NNNNNNNNNN
146501 NNNNNNNNNN NNNNNNNNNN NNNNNNNNNN NNNNNNNNNN NNNNNNNNNN
146551 NNNNNNNNNN NNNNNNNNNN NNNNNNNNNN NNNNNNNNNN NNNNNNNNNN
146601 NNNNNNNNNN NNNNNNNNNN NNNNNNNNNN NNNNNNNNNN NNNNNNNNNN
146651 NNNNNNNNNN NNNNNNNNNN NNNNNNNNNN NNNNNNNNNN NNNNNNNNNN
146701 NNNNNNNNNN NNNNNNNNNN NNNNNNNNNN NNNNNNNNNN NNNNNNNNNN
146751 NNNNNNNNNN NNNNNNNNNN NNNNNNNNNN NNNNNNNNNN NNNNNNNNNN
146801 NNNNNNNNNN NNNNNNNNNN NNNNNNNNNN NNNNNNNNNN NNNNNNNNNN
146851 NNNNNNNNNN NNNNNNNNNN NNNNNNNNNN NNNNNNNNNN NNNNNNNNNN
146901 NNNNNNNNNN NNNNNNNNNN NNNNNNNNNN NNNNNNNNNN NNNNNNNNNN
146951 NNNNNNNNNN NNNNNNNNNN NNNNNNNNNN NNNNNNNNNN NNNNNNNNNN
147001 NNNNNNNNNN NNNNNNNNNN NNNNNNNNNN NNNNNNNNNN NNNNNNNNNN
147051 NNNNNNNNNN NNNNNNNNNN NNNNNNNNNN NNNNNNNNNN NNNNNNNNNN
147101 NNNNNNNNNN NNNNNNNNNN NNNNNNNNNN NNNNNNNNNN NNNNNNNNNN
147151 NNNNNNNNNN NNNNNNNNNN NNNNNNNNNN NNNNNNNNNN NNNNNNNNNN
147201 NNNNNNNNNN NNNNNNNNNN NNNNNNNNNN NNNNNNNNNN NNNNNNNNNN
147251 NNNNNNNNNN NNNNNNNNNN NNNNNNNNNN NNNNNNNNNN NNNNNNNNNN
147301 NNNNNNNNNN NNNNNNNNNN NNNNNNNNNN NNNNNNNNNN NNNNNNNNNN
147351 NNNNNNNNNN NNNNNNNNNN NNNNNNNNNN NNNNNNNNNN NNNNNNNNNN
147401 NNNNNNNNNN NNNNNNNNNN NNNNNNNNNN NNNNNNNNNN NNNNNNNNNN
147451 NNNNNNNNNN NNNNNNNNNN NNNNNNNNNN NNNNNNNNNN NNNNNNNNNN
147501 NNNNNNNNNN NNNNNNNNNN NNNNNNNNNN NNNNNNNNNN NNNNNNNNNN
147551 NNNNNNNNNN NNNNNNNNNN NNNNNNNNNN NNNNNNNNNN NNNNNNNNNN
147601 NNNNNNNNNN NNNNNNNNNN NNNNNNNNNN NNNNNNNNNN NNNNNNNNNN
147651 NNNNNNNNNN NNNNNNNNNN NNNNNNNNNN NNNNNNNNNN NNNNNNNNNN
147701 NNNNNNNNNN NNNNNNNNNN NNNNNNNNNN NNNNNNNNNN NNNNNNNNNN
147751 NNNNNNNNNN NNNNNNNNNN NNNNNNNNNN NNNNNNNNNN NNNNNNNNNN
147801 NNNNNNNNNN NNNNNNNNNN NNNNNNNNNN NNNNNNNNNN NNNNNNNNNN
147851 NNNNNNNNNN NNNNNNNNNN NNNNNNNNNN NNNNNNNNNN NNNNNNNNNN
147901 NNNNNNNNNN NNNNNNNNNN NNNNNNNNNN NNNNNNNNNN NNNNNNNNNN
147951 NNNNNNNNNN NNNNNNNNNN NNNNNNNNNN NNNNNNNNNN NNNNNNNNNN
148001 NNNNNNNNNN NNNNNNNNNN NNNNNNNNNN NNNNNNNNNN NNNNNNNNNN
148051 NNNNNNNNNN NNNNNNNNNN NNNNNNNNNN NNNNNNNNNN NNNNNNNNNN
148101 NNNNNNNNNN NNNNNNNNNN NNNNNNNNNN NNNNNNNNNN NNNNNNNNNN
148151 NNNNNNNNNN NNNNNNNNNN NNNNNNNNNN NNNNNNNNNN NNNNNNNNNN
148201 NNNNNNNNNN NNNNNNNNNN NNNNNNNNNN NNNNNNNNNN NNNNNNNNNN
148251 NNNNNNNNNN NNNNNNNNNN NNNNNNNNNN NNNNNNNNNN NNNNNNNNNN
148301 NNNNNNNNNN NNNNNNNNNN NNNNNNNNNN NNNNNNNNNN NNNNNNNNNN
148351 NNNNNNNNNN NNNNNNNNNN NNNNNNNNNN NNNNNNNNNN NNNNNNNNNN
148401 NNNNNNNNNN NNNNNNNNNN NNNNNNNNNN NNNNNNNNNN NNNNNNNNNN
148451 NNNNNNNNNN NNNNNNNNNN NNNNNNNNNN NNNNNNNNNN NNNNNNNNNN
148501 NNNNNNNNNN NNNNNNNNNN NNNNNNNNNN NNNNNNNNNN NNNNNNNNNN
148551 NNNNNNNNNN NNNNNNNNNN NNNNNNNNNN NNNNNNNNNN NNNNNNNNNN
148601 NNNNNNNNNN NNNNNNNNNN NNNNNNNNNN NNNNNNNNNN NNNNNNNNNN
148651 NNNNNNNNNN NNNNNNNNNN NNNNNNNNNN NNNNNNNNNN NNNNNNNNNN
148701 NNNNNNNNNN NNNNNNNNNN NNNNNNNNNN NNNNNNNNNN NNNNNNNNNN
148751 NNNNNNNNNN NNNNNNNNNN NNNNNNNNNN NNNNNNNNNN NNNNNNNNNN
148801 NNNNNNNNNN NNNNNNNNNN NNNNNNNNNN NNNNNNNNNN NNNNNNNNNN
148851 NNNNNNNNNN NNNNNNNNNN NNNNNNNNNN NNNNNNNNNN NNNNNNNNNN
148901 NNNNNNNNNN NNNNNNNNNN NNNNNNNNNN NNNNNNNNNN NNNNNNNNNN
148951 NNNNNNNNNN NNNNNNNNNN NNNNNNNNNN NNNNNNNNNN NNNNNNNNNN
149001 NNNNNNNNNN NNNNNNNNNN NNNNNNNNNN NNNNNNNNNN NNNNNNNNNN
149051 NNNNNNNNNN NNNNNNNNNN NNNNNNNNNN NNNNNNNNNN NNNNNNNNNN
149101 NNNNNNNNNN NNNNNNNNNN NNNNNNNNNN NNNNNNNNNN NNNNNNNNNN
149151 NNNNNNNNNN NNNNNNNNNN NNNNNNNNNN NNNNNNNNNN NNNNNNNNNN
149201 NNNNNNNNNN NNNNNNNNNN NNNNNNNNNN NNNNNNNNNN NNNNNNNNNN
149251 NNNNNNNNNN NNNNNNNNNN NNNNNNNNNN NNNNNNNNNN NNNNNNNNNN
149301 NNNNNNNNNN NNNNNNNNNN NNNNNNNNNN NNNNNNNNNN NNNNNNNNTA
149351 TAAAAAATGT AGGCTGGGTG CAGTGGTTCA GGCCTGTAAT CCCAGGACTT
149401 TGTGGGGCTG AGGCGGGTGG ATCACGAGGT CCGGAGTTCG AGACCAGCCT
149451 GGCCAAGATG GTGAAACCCT GTCTCTACTT AAAATACAAA AATTAGTTGG
149501 GTGTGGTGAT ACCGTGCCTG TAGTCCCAGC TACTCGGGAG GCTGAGGCAG
149551 GAGAATCGCT TGAACCCAGG AGGCAGAGGT TGCAGTGAGC CAAGATTGCA
```

FIGURE 3RR

149601 CCACTGCACT CCAGCCTGGG TGACAAGAGT GAAACTTGTC TCAAAAAAAA
149651 AAAAAAAAAT CTGAACCACA GTGATGAGAA AAATTAAAAT TGGATGAGCT
149701 AAAATATTTA CAGACTTAAC TGAAAGTATA TTGAACAAAG CAGGAATGTG
149751 CTGAGTGATT CAGAGACTTT TAAAATAAGT GTTTACAAGG AATCATTGAA
149801 GAAAATTTGG ATAAGAGTAA TGGCATTAGT GAATCAAAAT ATGAGATCCA
149851 AAGAAGAGGG ATATCTACAA AGTTGCTGAG AATTTGAAGA TAAAAAGGAG
149901 AAAATAAGTG TTGACAGTGT TGCATGGCTA AAGATATAAC TATGGTAGAC
149951 AGACGTTCTC AATTTAATTT TTAAAATTTG GACAAAATAA AGATACAAAA
150001 TGGGACTTCT CATATCTGGA AACCTTTTTA TATATGCAGA AGCAAGCTTT
150051 ACTTAGTTTT AATAAAACTT TTCAATTTCA CAATGTAGAT AATTTGTAAC
150101 TGGGAATATA TCAGAGACTC AGAGAATCTT GTAACTGACA AGTATACTAG
150151 AAGTTATTAA ATTTCAATCA GCTGTTAATT TCTGTCAACT TAGCCCTGAT
150201 TGGTGTTGTG AAAATAATAG AATCCTTGAG AGTACATAAT CAACTCACAT
150251 TGGAGTTCTC AGAAGTTAAG AAAACAAGTG GGCTAGGAAA AGTAATAATT
150301 TAATTCTGTT AATTTTTAGT TAGCTTGAAT AAAGAGAGAG ATTCTAATGA
150351 CCCATGACCC ACATGTATTG AAAACATGTT GTTATATGTT TGTTTTTACT
150401 TATTTGGCAT TCCTTTTTTA TTGCCAAATA CTATTCAATT ATATGACTGT
150451 ATTACATTTT ATTTATGCAT TCATCAGGTG ATCATATTGG GTTGTTTTCA
150501 CTACATGTGG AAACTGAAAT ATTTGACCAA AAGACGTAGA GAAAATGTGG
150551 TAAAGTTGCA CCTCATAGCA ACTAGCTTAA AAGAGTTCCT GAAATCTCAG
150601 CAGTGGGAGT TTGTTGGGCT GTACTTTGTA TTTTCCAAAA ACGTGACTCA
150651 ACTACTCATT GAATATTAGA TTCTTTCTCC ATGCTCTACT GTTGTGTCTT
150701 GACCAGCCTG GTTGACATGG TGAAACCCCA TCTCTACTAA AAATACAAAA
150751 TTAGCCAGGC GTGGCGGGGC ATGCCTGTAT TCCCAGCTAC TTGGGTGGCT
150801 GAGGCAGTAG AATCACTTGA ACCCGGGAGG CGGAGGTTGC AGTGAGCCGG
150851 TACCCCGCCA TTGCACTCCA GCCTGGATGA CAAAAGCGAA ACTCTGTCCC
150901 TAAAGAAAAA AAAAAAAAAG AACTTGACTT TCAGTTCTGC CATTTGCTAA
150951 TTCTCTGACT TTGGGATGTT AGCTCAACTT TCGTAAAACT CAGTCTCCTT
151001 ATATGTAAAA TGTGAATAAT AATATTACCT ACCTCATAGG ATTTTTGTGA
151051 GAGCTAAAGG TTATATTGCA TGTAAATCTC TAGTACAGTG GTTTTATTCA
151101 TTCAATAAAT ACTATTAATA ATATTGATTA CAATAATAGT CAATGATTTT
151151 CATTTACTTG CACTGGTTAT TTGCATGGTG TTCTTATTGT TAGAGCTTTT
151201 ATATCACCCC ACAGAACCTC TGTACCCATT AACAGTCCTT CATTCCTCCC
151251 ATCTCAAGAA CTAGACAAAC GGTAATCTAC TTTCTGTTTT TATAGATTTA
151301 CCTATAGTTG GCATTTTGTA TAAATGGAAT CATGCAATAT ATGTGGTCTT
151351 TTGAGTCTGG CTCTTCCACT TAGCGTGGAA CTCACCCATG TTGATGAGAG
151401 ATTCTTTCTA CTTAGGACTC ACTCATGTTA TTGAGTGATT CTTTTTATTG
151451 TTTAGTATTC CTTTTTATTC CCGAATACTA TTCAATTGTA TGAATATATC
151501 ACATTTTATT TATGCATTCA TCAGTTGATG ACATTGAGTT GTTTTCACTT
151551 TTTTCTAGTA TGAGTAATGC CGCTGTGAAC ATTCATGTAC AAGTTTTTGT
151601 AAAGCGTATG TTTTAAATTC TCTTGAGTAT ATACCTAAGA ATGGAATGCT
151651 GGGTCATTTG GTAACTCTAT GTTCAACATT TGAAAAAATT TCCTCTGTTT
151701 TCTAAAGTGA CTGTGCCAGT TTACATTCCC ACCAGAAATG CTTGAGTGTT
151751 CCAATTGCTC CACATTTTCA CCAATACTTG TTTATTGTCT GGTGTTTGTT
151801 TGTAGGCATC CTAGTAAGCG TGGAGTGGTT TTATATTTTG GTTTTGATTT
151851 GTGTTTCCCT AATGGCTAAT GGTGTTGATA GCTTTTCATA TGTTTATTAG
151901 CCATTTGTCT ATTTTCTTTA GAGAAATAGC TATTCAAATT ATTTGCCCAT
151951 GTTAAAATTG GGTTATTTTT ATTTTTGTTG TCTAGTTGGC AGAATACTTA
152001 TATATTCTGG ATACAAGTCC TTTATCAAAT ATATGAATAA CAATTTTTTT
152051 TTCTATTCTG TAGGTTGTTA CTTTCTTCAT GGTATAATTT GAAGCACAGA
152101 TATTTTTACT TTTAAAGTGT AATTAATCTA TTTTTATTAT AGTGTTTTCC
152151 TTTTGATGTC ATATCTAAGA AATCAATGAC TAATTCCAAG TGACAAAGAT
152201 TTACTCCCAT AAATTCTTTT AAGATTTTTA TAGTTTAGCT TTTATATTTA
152251 AGTCTATGAA CCATTTTTCA TTAATTTTTG TGTATTGTGT AAGGAAGGGG
152301 TCTGACTCAT TTTTGTGCAT GTGGATATCC AGCTGTCTTG TTTTGTTTTT
152351 CAGTAATAAA TACATTGCTC ATGAAACAGA AAAACAAAAA AAATCAAAAC
152401 GAAACATAGA AAAAGACAAA AAGGGAACCA CTTCTGCTTG GAGAGAATAG
152451 AGAAAATTTA CTTAATATGT AATATTTGAA GTATTTGAAA GTTTCCCAAA
152501 ATGTGAATAG AATTGGGATG AGTAGAGAAA AATATGAGGG CAAGAAAATT
152551 ATAGGCATAG CTGGAAAAGA GAAAGTGCCA AAAAGTTAAA ATAACTATTT
152601 CATTTTGGCA ATAATATACT TTACAGAGAA CCTGGAACCT AACCATAAAC
152651 ACACCCTGAG AAAGTGATGC AAGTACGAGT AATGTCTTTG AGGAGTGCCT
152701 CAGAGTTATT TTACCCTGGA GGCAAATGAG CTGGTGTATT TGTGAACCAG
152751 TTCTTTAGAG TACTTTGGTA AGGACTATTT TGAGGTATGT GGCCTACATT
152801 TAGTTGATGT GCTCAGGGTC TGAGATCTCA TGCAGAGTGG AAAGTGGTCT
152851 TGGAGAATGA TTTTTTCTTT ATTGGAGGTG AGAGCCATTA ATGGGTTTGA
152901 AGTCAGTATC CTCATCTTTC TCTCTTATTT CTGGGCATGT CATGATCTGT
152951 TAGCCGGTTC CAGAGATCTC TGTGCCTTAG TACTCCCTGG TTGCCACTCA

FIGURE 3SS

153001 AACTTGGCTT CCCGTTTTGC CACTTTTGGC AATTGCATCA ACCTTCCCTC
153051 TTATAGTTAA GTGTTGCCAT CTGGCCTCTG CTATTCTTAA ACCTCATCAT
153101 TTCTACTGAA ACTAGGGAAC GATTTTATAA GCAGATCCTA CCCCAATCTT
153151 CAAATATAGT CTACAAAGTA CAAAAAAGAC TGAGTTTTCA TGATGGAGTG
153201 TTCTCATTAG CACATTTATC TTTTGCTTTA AGGAAGAGTT TGTCTTTAGG
153251 ACCATCACAG GAACATAGCC AGCTGGTGGA TTCTCTAGTG TTGTTTAATA
153301 AATCCATGTC ACTATGTCTT TGAATCTTTT GACACCTTCA TCAAAACTTT
153351 ATACAGGTAT TTTTTAACTC TTTTATTCTA GGTTGTTATT TTATCTACAT
153401 ACTTCCAAGA AGCATGCTTA TAGTATATCA TAGCTGATTT CAGCTGCTGT
153451 TAAATTCTGA GTCATAGGTG AATAATCTCA TATCAATCGA CTCTGTTTTA
153501 CCTACCTTCT ATCCTTCTCT CCCTTTCCAC TAGTCTTGAG ATCCATTCCC
153551 AAGCATGGTT TCACAGTTCT TGCCAGTTCA TATTAGCCAG GCCTTGCAGG
153601 TCTTTTGATG AATAATCCCT TCCCTTACAA TGAAGGGAGA AAACTTGTAT
153651 AGCTGGATTA AACTGAGAAT TGACTGTAAT GGTTGACCTA GAAGTATTAA
153701 GAAGAGAGGG AAGGAAGAGC TTGAAGAGGG CAGGTTTCAT CTTGCCAGAC
153751 ATCTGAGGTA AGGCCTCTGA ATGCCCCTCA GGCAAAGGGA GGCTACTGTC
153801 CTTTAGCAAG AGTGATTGAG CCACTTTTGT AGGCCCACAG ACAGGTTTTA
153851 GGGAAATCTG GGGCTCAAGT TCTCAAATGT ATCTATTCAT CTCTATTCTA
153901 TAACTTAGAA CCTTATCCAT CTGTCACTTA CTTAAGAGAT ACAGTGATAC
153951 TGCAAATTCA TTCTTCTTTA CAGTTTGGTT CATTGCACAG TCAGATCCTG
154001 GTCTTGGTTT GCATTCCTGT TTGTCTTTTG GGTGCAGGAG AAAAGTGTCT
154051 TTATAGATGC TATTATGAAA GCTTTGTATT TCACACCATA CTCTGAGTTG
154101 GAGGTTGGCT AAATTGAGTG TGTCATTTTT TACTTCGCTT AATAAATTGA
154151 TGGCACTTAA CAATAACCAC TGTCTTTATA ATTTCCTTTG CTATAGAAGA
154201 ATAACTTTCT CCAATCCTAG ATATTTTGCA TAAACTAGCA CAGCCCTTCT
154251 ACCTGTGTGA TACACTTCAG TTTACTACAG GTAAGAATGT TGGCAATTGA
154301 GATACTTCAG GATGTTAGCC TATCCACAAT CCTACTTACC ACCAGCAGTG
154351 GAGTCCTTGT TATCATTTGG CCAGTGAGTA ATACAAGCAC TAGGATGTCT
154401 GCTTCCTAGA ATAATTTTCA TACCAATTGT TTTAGTTGCA GTTTCCCCAT
154451 AGCTGATTTT GAGATAGGAA TTTTAAGTGC AGGTAGTTTA TTTGGGAGAT
154501 TCAGGGAGCA TGGGTTGGGG AGGGGAAGTG ATACAGAAAA AGGATGACTG
154551 CAGTAAAGGG TGCTTTATTA AGCTACTTAA CACCATTGAT AAGTGGAGCC
154601 TAATCCTACC AGGACATTTG AGGAAATCAC ATAAAACACG TCTCATGTAC
154651 TAAATTCCAG GAATTATTTG CTGAGGGCTT TTCCTCTAGG GATGTTGATT
154701 CCTCAGCACT TTCTGACCTG ATGTGTACAC AGACAGAGAA ACCTTCTGCA
154751 GTTTTGTTGG AGACAAAACC CAGCCTTCAC ACACAGAGCT GATGTTAGAG
154801 CATCCTGAAA GGTCTAAGGA AATGGGCAGA GCTTTGATGG CATCTCCCAC
154851 AGAACAGTGA AATGAAAGTT AATTGGTGTC AGACCATGGA GAGCATTGAA
154901 TGCCATTCAA GGAAGTATTT AGACCTGATA TTCTCTAAAG CAGAAATGTA
154951 ACATGATAAG AATTGTGCTT TAGGATAGTT ACCCCAAAGT ATTGTGTAGA
155001 ATGGATTAGA GAACAGAAGC TAGAGTTGAG AGTGTCATGG AGGAGGAATA
155051 ACAATGATGA TCTTCATCCT GTTTCCAGTT CTCACTGGGA ATTGCTCCCA
155101 GTTCTAATAC TAAACCCACT TTTAGACGGC CTAACTAGAT AACATTCTGA
155151 GCCCACTCCA TCAAGAGAAT TTCAGATAAA GAGATTCCAT TTTCAAAAGA
155201 ATTGAGAATT TAGTCAGTCA GAAAATTTGC ACTGTCCCTT TTAAGCTTAA
155251 TTTTTTTTTT TAGCTAAAAC AAATTAGCCT TATTTGCTCA GAAACAGCCT
155301 TATATAAAGA GAACCAACAT TGACCTTGCC TGTGCTTGCT AATTTACCAT
155351 ACTTGTTTAT TCACCTCTAA GTGCCCTTTG AATCCCATTT AGTAATTCAT
155401 CATTCTTGAT AGTAGTTTAC CAAAGACAAA GGAATAGAAA TTAGCTGAGT
155451 AAGAGAAAAA CAAATGAAAA GGAGGGAGCA TTTCAGGCAC GGTGGCTCAA
155501 CACCTGTAAT CTCAGCACCT TGGGAGTCTG AGGCTTGCGG ATCGCTTGAG
155551 CCCAGGAGTT TGAGACCAGC ATGGGAAACA TGGTGAAACC CTGTCTCTAC
155601 AAAAAATACA AAAATTAGCT GGGCATAGTG GCATGTGCCT GTAGTCCCAG
155651 CTACTTGGGA GACTGAGACA GGGGGATTGG AGAATCGCTT GAGCTCAGGA
155701 TGCGGAGGTT GCAGTGAGCT GTGATAGTGC CATTGCACTC CAGCCTGGAT
155751 GACAGAGTGA AACTGCATCC AAAAAAAAAA AAAAAAAAGA GGGGCACTAA
155801 AGAGAGCACT TTTCTGAATA ATCCCAAACC AACTTAAAAG GGTAAAAACT
155851 AGGCAAAGAA AACGTTTTCA TTTGCTCAGC ACTAATCTAG TAATAATGCG
155901 TTAGTTTGTC ATTTTCACAT AGAACACCAA TAAACCAAAA CAAATTAGGC
155951 TAACTTGGAT TTCCATCCCC TCATGCACAA ATTTAATCCC CTACAGATCT
156001 TTAGCCATAT TTCTGGGACT TATAGTCAAA ACCCCTCTTC TTTTCACCTT
156051 TCCAATATTG AGGACTTTGT TACTGGGTCA ACTGTCAATA GCCTTTCTTT
156101 TTTATTTTGG AGAAATTCTC TATAAATGTA TGCTTTTTAT TGTTACATAA
156151 TTCAATGCAA AGACTTCTGT AGGGTTTAGC AGTTTACAAT ATATGGCTGG
156201 GTATTTCCAT ATCTACAGTG GAGGCAACTT GAGTCCATTT CCAGAAAACT
156251 CATCATCTGT CATGCAGTGG AGCTCTGTTG TCTCCTGCTA ATTAAACAAA
156301 AGTGAACAGA TATGCCAGAA TACAAAGTGG TGGGAATAAA TACTGTGGTT
156351 TCAGTTGTGA TCTCTGCTAC ACATGTTTAT ATAAAGTAAA TAACATTTGC

FIGURE 3TT

156401 GGTAATCAGT TTTTATAAAA CTCTGGCTTT GAGTAAAATA ATAATTATAT
156451 TTCAAAGATG CTATAAACCT ATTCTTCAAT TTGCCACAAT GAGAAGGAAG
156501 TTCAGTCTTT TCATGTGCCT TTATTCCAGA CATCCAAATC TCTAGAATGG
156551 TTTATTTATG TATAAGAAGT AAGATCCAGT AGTCTTTTTA AAATTAAAAA
156601 TACACATTTT AAAATTAAAA ATAATATATT TTTAATATTT GTGGGTCCTA
156651 ATAGGTTTAT ATATTATGGG TACATGAGAT ACTTTGACAT GGGTATGTAA
156701 TGCATAGTAA TCACATCATG GTAGATGGGG TATCCATCCA CCCCCTCAGG
156751 CGTTTGTCTT TTGTGTTTCA AGCAATCCAA GTATGCTCAT TCGTTATTTT
156801 AAGATGTACA ATTATTATTG AAGATCCAGT AGTCTTGCCA TTCTGCAGAA
156851 AAGAGGTGGC CCCTGAGGCT GGAAGGCCCA ATCACAGCAG CCTGTTAAAA
156901 CTGGTTGATT ATTTCAGTGC CACATTATTA TCATCGGTCT ATGCAAGTCC
156951 TCTCTTGCCT TTATTTATTA TTTAATACTA TTTCCTACTC ACATTCTTCT
157001 TTGTTCATCT TAGACAACTG TTCTATTTTG TTTGAGGGGG AAACTTTAAT
157051 TTGTATGTAT TATTAAACAA TGTGAATTGT TTTGTGACTG TGTTGTTTTG
157101 GTTTTTATAG ATAACATTGT ATCATAGATC TGATTTTGAT CCTTACTATT
157151 TTTTTCATCA TCTCTTTGTT ATACGATCTG TGTTTGTTGC TAGGAGTACA
157201 TTGACTGTTT TAGCACTGAT TGATGCATAC GTTTCACTGT TTAGATCCAC
157251 TATATTTTAT TTATCCCTAA TGATTATCTC CAATTTCCAG TTACTACAAA
157301 ACATGCTCTG ATGAATGTAC TTATCCGTTT CCAGTTATAG ACTTGCTAAT
157351 TATTTCCCTG GGATATATGT ATTTGTGAGT GTGTGTATGC ATGTGCACAT
157401 TGTAGAGTAT ATGCATACTC AAGTGCTAGC AAATTACTCT CTGTAATGGC
157451 TGCAAAAGTC TACTGTCTTC ATCAATAGTA TTGTCAAAAG AAAAACTTCA
157501 GCTGAATTAA ATTTAAAGCA GTTTAATTGA GCAATGAACA ATTCACGAAT
157551 CGGGCAGCCC CCAGAATCAC AGAAAATTCA GAGAGACTCC AGGGATGCCT
157601 TGTGGTCAGA AAAAAATATA GACAAGTAAG AGAAATGATG TACAGAAATC
157651 GGAAGTGAGT TTCAGAAACA GCTAGATTGG TTGCAGGTTG GCATTTGCCT
157701 TATTTGAACA CAGTTTGAAC ACTTAGCAGC CTCTGAGTGG TTGAAATATG
157751 GCCTCTGGGA TTGGCCTAGA CTCAGTTACT GTTACAGGAG CATATTCCTA
157801 AGTTAGTTTT CAATCTTGTC TGCCTATTAA GCTAGGTTAC AGTTCATCTA
157851 CAAGGACTCA AATATAGAAG TAAGGTGTTT TTCTCAGGCC ATATTTAGTT
157901 TGCTTTAACA CCGTATAAGG CTTCTTACTT ACCTACCTCC CTAACAATAC
157951 TTGAAAAAAA TTGGTTTTTC ATTTTTACCT ATCTAATGGG CCTAAAATGT
158001 TACTCTAGTG CTGTTTCAGT ATCTTTATAT TTTAATGAGT GTGTGAATCT
158051 TCTCATATAC TTGTTATTTC AACTTACTTC TGGAAAATGT CCTTATAACA
158101 TCTGAGTATT TTAAAAAATT GGAGAAGCTA TCTTGTTATT ATCCATTTGC
158151 AAGAATTCTT TATGTAGTTT ATATTTTTTC TTACAGATAT TAATGCTGCA
158201 AATAACATAT ATAAACCTGT CATCTACCAG TTTTATGTAT GATGTTGAGT
158251 AGAAATCCTT ACTTTTTACA TAATCAAATT TACCAATTTT TCTCTTTATA
158301 TTTTGTACTT CAGATTTTTA TTTAAGGAGT TTTATCCAGC CCTCGTTCAG
158351 CAACATTTGT TTATACTATG TATTAATGTA TAATTTTACC TTTCGTATTT
158401 AAATCAGTAT TCTTTGAGGA TCAAACTTCT TATAAAGGGT TTATGTAGAG
158451 AGGCAGTTTT ATTTTTCTTC ATATAGTAAG CCAGTTTGCT ACTGAACAGC
158501 CAGAATAGTT GCACTGTGAT TTTGTATGTA CAATTTATTT GATACTTACT
158551 TCTCATGTAA ACATGGTCTT GTTTGAGCTC TGTATTCTGT TCCCATGATC
158601 TATTTCTCTG TTATTGTGTT AGTGAACAAA ATTTTATTAC TGTGGAATTA
158651 TAGTATATTA TATATCAGTA AGACAATTAT TAATTTAGGA TATTTTTATT
158701 GAATAAATTA GGTATTCTTG AAATGTTATT CTTTCTGTGA GTTTTAAAAT
158751 AAGTTTACTG AGTTTTTAAA AAATGTTAAA CTGGTATTTT GATTAGAATT
158801 GAATTGAATT TATAGATAAA ACTGGGGGAA ATTGTTATTT ACAGCATTAA
158851 AGTATCCCAT CATTAATACG GATTACAGTA ACCCATCCAA GGGCATCAAA
158901 TGTGCTTTCA TTTATTTAGG AAGTCTTGTG AGACCCTTAC AGGGAGCCAG
158951 CTGGCAAAGC AGAAATGTGG GTTGACAGGG TTCAGTCCTA GTGCCATAGA
159001 GCAGAGTACA GAAAAATGCC TCTGAAGCCA AGAGACGATG ACTTAATGAT
159051 TACTCAGATA GGAATTTACT GTTTCTTAAA AATTTGGTTG AATTTATTTA
159101 AATTAACTTG CCTAGAGATT TGGCGTAATT ACGTATCTGC TCCCAAATTA
159151 GTTTAAGCAA TGTTTTTGTT GTTACTGTTA TTACTTTTTA GGGGGAGAGA
159201 TTTGTGGATT TTTTGTAGTA AATAAGGTTG TTATGTATTT ATTATCACAA
159251 TTATAGGAAT TTTCCAGAAT TGATTAAGGA TATTTTAGTT TTCTATGCTT
159301 GGAAACTGTT TTTGTGATGA GATTTATGCT GACACAAGGA AAATGACATA
159351 TTTTTATGCT CACACAAGGA AAGTAACATT CTCTTTTACA ATGTGATTTT
159401 TCTTCTTTCT CAGGCGTATA TAATTATTCA TTTTTCTATT AACTTATAAA
159451 CTATTGCATT TACTTTAAAT TTTGTCCTAA TATTTACTGT GTTAAGTATA
159501 TGTTAGATCC TTTAAGTATA CTGACTTCTA ACGTAAGCTT CTTGCCTGTG
159551 GGAACCATAT TTAATTATGT GTAGCATTTA GCTTAATTCT GTGTCATTTT
159601 AATTTTTAAC CACTTAGGAA AATAACATTT TCCTTGTGTA AGCATAAAAC
159651 TTATGAAAAA TCTAAACATT CATAAGTCAT GAAGAAGAAA GAAAATTCAT
159701 TGATAATCCC CTCTTTGAAA AATAATTACT CTTGTTTCAG GTTTTGAAGA
159751 GAACTTTCCT CAGCTTTGTG AGTGTGCTTC AATGCTATGA ATACACACAC

FIGURE 3UU

159801 ACACACACAC ACACACACTT TATGTAACAT AGGTTATATA ATAAGAAATT
159851 ATTATATAAT TTTAGATGAT ATATATTATA TACAACTTAA TGTATTACAT
159901 TATATAATAT ATGATATATT ACTGTATGTT TTAAAAATTA TTATAGTTTA
159951 CTTTTTGTTT TATAATTAAA TTTTTCATTT ACTAGTATAT TATGAATACT
160001 TTTCCAAGTC ATTGAATGTC TTTTTCACGC TGAATTTTAC TGACTGTATG
160051 ATATTCTGTC ATTTCACTTT GCCACAATTA TTTTTCAAAC TTTATTATCT
160101 CATGATAAAA TTCTAGAAGC AGAATTACTA GATCAGTGTC TTAAATAACT
160151 TCTTAGAATG TTTACATATG TTGCCAAGTT TTTCATGATT GATTATCGTG
160201 TACCAATATC TTTTTCTAGA AATCCATTTT AACTGTTTTG GATTATTTTG
160251 TTTTAGTTGT TATCTTTTTA ACAACATAGA ATTGANNNNN NNNNNNNNNN
160301 NNNNNNNNNN NNNNNNNNNN NNNNNNNNNN NNNNNNNNNN NNNNNNNNNN
160351 NNNNNNNNNN NNNNNNNNNN NNNNNNNNNN NNNNNNNNNN NNNNNNNNNN
160401 NNNNNNNNNN NNNNACGGCA GTTGGATTTT GTTTATTATA AGATCTGGGA
160451 GTCTTTATCT TTTAAAAGTG GATATTTAGC AATTATTGTT TGACAATTGA
160501 CATGTATCCT TTGTCTTCTG TATCCTTTGT CTTCTGTTAT GAGCTATTGT
160551 ATACCTTTTA TTTATATGCT TACTATTTTT TTCTCTTCTC TTTATGACTC
160601 ATTCTGTAAT ATTTTCTGTA GTTTACAATG TAGTTTTTCT ATTTTATCGG
160651 GTGTATATAA TTATTTATTT TCTATTAACT TATAAACTAT TACACTTAAT
160701 TTTTGTTCTA ATATTGACTG TGTTAGGTAT ATGTTAGATC ATTTAAGTGT
160751 ACTGACTTTG GATGTAAACT TCTTCCCTGT GGTAACCATA TCTAATTATG
160801 TGTAGCTTTT AGCTTAGTTC TGTGTCCTTT TAATGTTTGA CCACCTAGGA
160851 AATGTGTATT GCTTTGCTTA TTGGATTTAA CTGTAAACTT TAAATTGGAT
160901 TTAAATTGTA AACTACCATA GAGAAAATGG TAAAAGCACA CACACACACA
160951 CACACACACA CACATTCTAT GTATTTTGAG AGTAGCTTCA AAAAATATTT
161001 CATAAATATT TTTTGATAAA ATTCTCATTT CTGTCTCTTA AGAATATTGG
161051 ATTAATTAGA AGTATATATG AGGAATTAAC ATTTAATCAT TTTTGTCAAG
161101 TACTTAGGTA CTTACAATGA ACCTAAGTAC AAAAGTACCT AAGTACATTG
161151 GCATCCATAT AATGTATTTC AGAGCTGAAA GATTTATATT CCCAATGTGA
161201 CCTTAAAACT CTGTGTGATG CATCATAAGG TTCTTTACTG CTATGCTAAC
161251 AGCAATTTTA GTTTACTATT CTGTGCAATA TAATGTGCAA TATTCAGGGA
161301 TAGATTTTTT CCTTGAAGTT TGCTAAGCGA ATGACTATTA AGCATTGTTA
161351 TTTAGTTAGC CTCAAATATT CTTTTTCTTT CTTTTCCTTA AGAAAAGATT
161401 AATGAAACTT TTTCTAAAGG TTGTTTGAAA TAGTAGGGTA AGTTTATTAT
161451 GCTGTCTTTG GCATATTACA CAGTAGTGAT TGCACCAAAT CTACATAAAT
161501 GCATATGGTT CTTTATAAGC AGTTTTACAG AAATAATATA GTAAATCTAA
161551 ATTACACTCT GGGTAATTAA TAATTTGTGA AATTAAAAAA TAGAATGTAG
161601 AAGAAATTCT CAACCTGGTT CAGCAGTTTA AAACAACTCT TCTAACTTCT
161651 ACTAATTTGA TATACTAAGA TAATTTTTAA CAATTGGAAA TCAGCACCAT
161701 GGAATTATCA TAAAAGAATA ATACCTCCAC TTTGAGAATT TTCCCATTAT
161751 ATATGTACTT ACATGTTGTG TTTAAGAATC ACTAAATAGA AATATGCTAT
161801 ACAAAATTAA ATAATATAAC CAATTGTAAT TTTATTCAAG TCAGATTTTC
161851 ATATCTGGCA CCCTATAATT TCTACTGTTA AGTCAATTAA TGCAGATAAA
161901 CCTCATTTGA AGCCATTGGA ATGGCCGATG ATCGTGGATA TAATTTCTCA
161951 TGTAGGATTC TGATGTCAAG CAAGCTTTGA CCTTCCAAGA ACCATCCCTA
162001 TACAACTGAA ATCCTAAATA GAGCTATAAT TTTAATTGAA ATATGAAGGT
162051 CTAATATATT TTGAAAAACC AGGTCAAAAC ATATATCATT GTGAAGTGTT
162101 AAAGCAACAT TAGTGGTCCA AAATATAACC TAATAAGGTA TGTACAGAAT
162151 CATAATCTTA ACTTAAATGG TTCTCTGCAA ATTTTATTTC CATGTTGCAT
162201 ATCTTTAATA AGAAATAACT CTTCTCCAGA TTTCTGTGTG AAGATTGTGC
162251 TTCTGAACAA ACCAACACTC CACCAAATAT TTTCTTGTCA TGGTCACTGA
162301 TAAATTTTCT ATTAAAAATC TAGTATACAT TGAGTGGTTT TTATCTTAGT
162351 GGATCTTTCA GCATCATTTA ATATGCTAAA TACTTTCTCC TTCATTAATA
162401 ATTTCCTATT GTAATGTGTA CAGGACATCA CACTCTCAGG AGATTTGTCT
162451 ATCAATGTAC ATTAACATGT CCAGTTTGAA TATTCATTTC ATTTATTTCA
162501 TATGTGATGT TTATAAGAAT TATCAATTCA AAAGTTAATA CACTTAAATA
162551 TTATACCTTT TAGTTAAATA GAATGTTACT CAGAGTCAGG GCTATAGACT
162601 TTATTAGTAA TTACAGCAAA GATAAGTGAT TTTATTGAAT CTGTAAATAG
162651 TCTCTTTTTA TTAAAGTGCT TCTCCATTAA AGGATACTTC CTAAGCAGCC
162701 TGAATATTAC TTCACCTGTT CAGTTCACTC TCTCTCCTGA CACAGACACA
162751 TAGTCTAAAT ACCGTTTTCC TCTTCTCTGC CTCTTCATAC ACACACACAC
162801 ACACACACAC ACACACAAAC ACACACACAC ACAGAGCGAG AGAGAGAGAG
162851 AGAAAGTGCC TCTTAGTTAT AAACCTGAGT TTTCATCCTA ACTTATAATT
162901 GTGTGCACTA GCATGATGTC CAGTGAGTCA TGTGATGTTT GCAAGCTTCA
162951 GCTAAGTCAT ATGTTATGTT TCTGTTCACC TGAGCTCATC CTGGTGTCTT
163001 TAAAATGCTA TGGCTAGGTT AGGAGATTGC TAAAAGTTTA CATATTTTCC
163051 ATCTCATGTC ATATATAGAA TCATTACTTG AGCAGGAGTA GCTCTCCCAT
163101 TAGTGGAAGC ATTCACAGTT GTTTTAGTTA TAATTTAAGC TTTCTTATTA
163151 TTAATTTGTA TATTTAACAA CTATTAAGAA CCAACTGCAA TCCCTGTTGT

FIGURE 3VV

163201 GGGAACATCC TATGGGAGGC TTGTGTGGGA AGCTCTATGA TGAAAAGACA
163251 ACGTCCTTGT CCTAACAGAG CTTACGGTCT ACGTAAATTT ATCTTGATTC
163301 AAAGCCTTCA TGTGGTCCAA CATAACTTTT CACATACTTT TGGTGTTAAT
163351 TCTTCTGTTT TCTTTGTAAA CTCAGATGAG TCAATTCCCT CCTTTAAATC
163401 AGCTTCCTCA TCCATAAATC AGGATAATAT GCTTCATTCT CTATAACTTA
163451 CAAGAATCAA ATTAAATGTG GTTTGTGAGA TTATTTTTCT GTGCTTGCTA
163501 TATTTGGAGG TCCTATGTAA CTAGCATAGT ATTCATATAT TGTTGAACAT
163551 AAGACAGGGT AATTAAGATA AATATTTGCA ATCCCTTTAT TTAGAAATCC
163601 TATAAATCTT CAAAGATAAT ATTTGCAATA TTTTATTTAT CGTTAAGTAA
163651 GAATCTCAAC TTCGTAAGCC ATTTAAGGCC TTTTGGACAT ACAGAAGATG
163701 AACTGTTTAA TAAATTTAAT CTTCAGAATA TGACAGTTTT ATGGGATAAT
163751 CTATTCCTTC TTAGTAGAAG TTATCTTTAT TGCTATAATA TTTTAATCTT
163801 GTTAATAGGA CAAATCTACC AAAAGTAAAA CATTTAATTG GAAAANNNNN
163851 NNNNNNNNNN NNNNNNNNNN NNNNNNNNNN NNNNNNNNNN NNNNNNNNNN
163901 NNNNNNNNNN NNNNNNNNNN NNNNNNNNNN NNNNNNNNNN NNNNNNNNNN
163951 NNNNNNNNNN NNNNNNNNNN NNNNNNNNNN NNNNNNNNNN NNNNNNNNNN
164001 NNNNNNNNNN NNNNNNNNNN NNNNNNNNNN NNNNNNNNNN NNNNNNNNNN
164051 NNNNNNNNNN NNNNNNNNNN NNNNNNNNNN NNNNNNNNNN NNNNNNNNNN
164101 NNNNNNNNNN NNNNNNNNNN NNNNNNNNNN NNNNNNNNNN NNNNNNNNNN
164151 NNAATGCAGA GCCTTCACTT TTTCTGCTGC AAAAACAGAT TTATGTTATT
164201 AACTACATGC CTAGCAGCAG AATTCAGGGC ACTAATTTTC TAAGTTTATG
164251 TCAGTATATT GATACAAAGT GACTAAGTAG TTCTGAGGAA AATGTAATAT
164301 TAGAATAAGA AGACTTCTTT AACAAGCTTT ACTTTGATAC AGAATATTAG
164351 ATACGTATGT TTAAAAATTA AGCCACTGCA GAATTACAGA ATGAGATACC
164401 CGTGTACATT CAACAACCTT AGTTTATTTG GCTTATGCAA GGTAAGATGA
164451 AGAATGTTTG GAACAAATCA CATATGGGCC ATTTTGCAAC TTTTCATTCT
164501 CAGCCATTCT GCATTCTTAA TCTTAGAATG AAGTTGAAGA TTTTATTTCC
164551 CTTTTTGGCT CTCTTTCCCA TTTAAATTTA GTTGATTTGG AGGAATAATT
164601 AATTATTGGC ATATACTACA AAACATTGAG AACATATTAT ACAAAAAACC
164651 TGGCTAGAAA TTATAGATTT ATTATGATTT TGTTGTTGTA TATTGTTTTA
164701 ATCTATCTTT AAATTGTCTT TTACTTTTGG GAAAAAATAA TAATATGCTG
164751 TATCATTTGT GTATTAATCA TCTACCAGTG TAATGCTAGC TAATTTAAAA
164801 ACGCATTTAG TCTTTTGGAT TCTATATCTT TCAAATGGTC ACTTGTTATA
164851 TTCTATTTTC CATGACTATT CCCCCTTTAT ATATTTACTA TAAATACATT
164901 TTGAAGAAAA ACAATAAAGA AAAATATTAT CTCCAAGTAT TTATGTCCTT
164951 TTTAGTCTAT AACTGGGATC TGTTAGAAAT TGAGGAGGAA ATAAATTTAT
165001 GCCTTAATAG TTTTAGTATT AGAGGATATG GTCTTACAGC ATGTAATTAA
165051 CAAAAATCAA TACAGAAAAG GGAAGAGAGG AAAGAGATTT CAGAAACACA
165101 CACACAAACA CACACACACA CACACACACA CACACACACG TATTTAGGAA
165151 GCACAGGTAA AGACGAAAAT ATGTTTCTCC AACAGTCCCA GTCTTCCGTG
165201 TTATTAGAAT ATTTCCTTTT CTGTTACCTA CTGTCAGCAT ATTTAAGATT
165251 GGTTTTAACT GATATTTCAT TTCCTTAAAT CAGACCAGCC TTGCAGCTGT
165301 TTAAGGTCCT AAGGCATCTA GGGTGTGACT TCCCTCTCCC TTTTCTCTCT
165351 GGGATACATA CGCAAGCACA CTGGTCTGAA GGTAAATGCT CTTTTCTTTT
165401 GCTATGTTTT GAGTATTTTA TCAGGACTTA TCCTTGCCAT TTGAAAATAT
165451 AATTAGCTTT CCAATAGTCC GTTCTGTGCT AAGAAACAAA CTATCTGCTC
165501 CTATTTTAAA ATTTCAAAAT TGATTTTGGA AATAAAAGTT TATATTTCTT
165551 TGAATTCTAA AGATTTTCAG AGGGAAGAAG ATATAAATTT GAGAGATTTA
165601 TGTAAGAACT TTGGATGTAT GTGTCCATTT GCCAGCATAT TATCTGAATA
165651 TTCTTTGCCT AGAAAGGCTG TTTGATTGCC TTATTTTGTT CTCCAAGAAA
165701 AGAAAGCCAT CTGATTCCTC AATGACTGCC AGTTGCTTTA AGAATTAATT
165751 TCCTTGTTCT GACTTTCTAT ACCCAAAAGG AATCTGGTTT TTTGGCCTAG
165801 TTTATTTAGC TTGCTATAGA AACAAAAATT CATATGTGGA TGTAGAAGGG
165851 TTTTTAGAGA ATCCTCAGGC ATAAATATTA AATAGATTAA TTATTACTCA
165901 TAGCTATTCA CATTTCCTAT CACTTCTAAC AAATATTCAC TTCAGATGAT
165951 ACAGCCCCCA AACCACTAAG CTATATGCAC ACACTATTGG CAATTTTAAT
166001 CCTGTACCAT GTATATCCAG GAAGTAAAAC TTCTTACCCT TTTTAAAACA
166051 AATATACATA TAACTTATTC TTTAGCTGCG AAATGTTTAG ATGTACGTAA
166101 GTTTGGTAAT TGTAGCTATT ACAGGTTTAA AATAATTCAA TCTGTAATTA
166151 TTATAAATAT CTATATCATT ATAAATAAAT CTGTCATTAA ATCTGTACTA
166201 TTAAGAATCT CTATATTGCT GGGCACAGTG GCTCATGCCT ATAATCCCAG
166251 CACTTTGGGA GGCTGAGGGG GGCGGATTGC CTGAGGGTTC AGGAGTTCGA
166301 GACCAGTTTG GCCAACATGG TGAAACCCTG TCTCTACTAA AAATACAAAA
166351 AAATTAGCCA GGCATGGTGG CATGTACCTG TAATCCCAGC TACTTGGGAG
166401 GCTGAGGCAG GGAAATTGCC TGAACCCGGG CGTGGGGGCT GCAGTGAGCC
166451 GAGATCATGC CACTGGTCTC CAGCCTGGGC GACAGAGCGA GACTCCATAT
166501 CAAAAAAAAA AAAAAAAGAA AAAGAACCTC TATATTATAT AATATATAAT
166551 ATGATAGATT CTGTATATTA TATAATATAT GATATAATAG ATTCTGTATA

FIGURE 3WW

166601 TTATATAATA TATAATATAG TGTATACATA ATAAATATAC ATATTATAAC
166651 AGAATCTTTA TTATATATAA TATACTGTGT ATATTTAATA AAATATATAA
166701 AATATGTTAT TAATACAATA AATATATATA ATAAAATTAT ATATTTGTAG
166751 TATGATTAAT AATTATAAAT AATATAATGA AATTGTATTT ATAATATAAA
166801 GCTTTATTAT ACTTATAATT ATAAATAATG TATTAAAATT GTATTACACT
166851 TATAATAATT ACAAATAATA TATTAAAATT ATATTATTAA TTATTGATAT
166901 ATTATTAAAT TATTATTATA ACATAAAATT TTAAAACCTG GCTTTTTGGC
166951 CTAGTTTATT TAGCTTGNNN NNNNNNNNNN NNNNNNNNNN NNNNNNNNNN
167001 NNNNNNNNNN NNNNNNNATC TGTAAATTAT ATATGTCATT ATAAATACTT
167051 TTGTTATTAA ATCTGTACTA AGTTGGTCAG TTTGGTCAGG TGCTTGCTTT
167101 TACATAATAG GCACTGAACT AAAATATCCC AGTTCCTCTG TCTCTTTTTT
167151 TTTTTAATTT ATGTTTTTTA TGTAATATTT AAAATATCAA TATATAAAAT
167201 AACTCACCAA TATAGAAAGT AGAAAAGAGC TCAGTAAAGC AAAAATCGAA
167251 TTATACATGC TTCTACAGAA TAGAATATCT TGCAAACTAC ATCTATTCTT
167301 ATGTCCTGGA TAAATAGAAC AGAGAGACTC ATTTTGTCTT ATGTTCATTT
167351 TATGAATCCT TTTTTTTGGA TCAAGGAATG ACTATATGAG GAAATTTTGC
167401 CAGAGTCTCT TGTTCAATGA AAGCTTTTGG TTAAGCAAGA ATCAGCTGTC
167451 CTTTGACAGG ATGCCAGGAG GAATGTCTTA AGATCCATAT AACAATTTAT
167501 TCATTCTAAG ACATACATGT TGAATACAGT GTGATAAAGT CAGTGTGGTC
167551 ATAGGAGGAA ATGAGAACAA GGCCCGGAAA GAAGTTTATT ATACTCATAA
167601 GTCCCAGAGA GGGGGTCAGT GCATGCCATT CAGGGCCACA CAGGAAGCAC
167651 TATGTTTTGG TCAGGTGGTA GAAGACAGGA GTGAGGGGCA ATCTAGGCTA
167701 GAGCCTTTAC TAGGGTTTCT GAGGGAAAGA CAGGGCGGAG CAAAGCAAAC
167751 ACTTTGGTGT TTGCTTAGTT TGAATAATTC CTGTGGAATT TGGGCAATAG
167801 GGGTGGTCTA TAAGTACCAG ATACCTGCCC TATGATCGAT CATCTAGGGT
167851 AGGGGAAATA TTGCCTTGAT GTGTGAGAGT AACACATCAT AAGGAAGAGT
167901 TTGGGGCTGT AGACTTGGGA GGGGCAGACT TGCATATGAA GCTCCAGGCC
167951 CAGCCCTTTG CTATATCTAA TAATTGGCTA GCAATGAGAA GTGCAGTTTC
168001 TCCACCCATA CCATCTCCTC TCAGCAAGCT TTTTAAGAGG TCTTAACGTC
168051 ATAGAATACG TAAAATAAAG TTAGAAGACC TAGTTCTAAT TCTAGTCCAT
168101 GAAACACTGG GTAATTGATT TTATTCTTGG GTATTGGATT CCTTATTGTT
168151 ATTATGAAAA TAAAAATACC TGTCTTGCTT TATTGGACCA ATGAAGACCA
168201 AATGAGTTAA CATTTGTGAA AAAGTTTTGA TGAATATAAG TTCAGTATAT
168251 AAATAGTGGC CTTAAGGATC ATTACATCCA AGGTAACCTT GTAGTACATG
168301 AAAGAAAGAA TTCCTTGGAG TACAAATCAT TCTTGCTTAA CCAAAACTTC
168351 TCATTGAGCA GGACACTTAG TTACAAAACT TTTCCATCCA TCTCTTTGTC
168401 ATCCATCTGT CCACTCCTTG ATCCAAAAAA GAGCTCACAA AATGACCATA
168451 GACAGAAGTT CCTTGTTCTA CTCATATAGG TCATGAAAAC AGAAATTATT
168501 TGCAAGATTT TCTTCCCTGC AGAAACATGT ATTATTTAAT TTGATTTATT
168551 TAACTCTTTT CTACATTATA TATTAGTATT TTATTGTAAG TTCTACATAA
168601 AATTTTTCTT AAAAAGCATA CATGTGATTG AGGAGTTGTA ATGTTTTGTA
168651 TTCATTACCT ATTATATAAA AGCTAGCACC TGACAGAAGT GCAAAATTAA
168701 TAGCAAAATT AATGACAGGT TTGATAATAT ACTTTATCCT GTAATTTGTA
168751 CATTTACCAG GTTTATGCAT GTCTAAGTAT TTCACAGTTG GATAATAAGT
168801 TATATGTTTG TTTTAAATAG GGGTAGGAAC TTTAAGTGGG ACAGAACTAA
168851 AGTTGTCTAA AAGTGTATGC ATATAGCTTA GTTTTATAAA TTAATTTCTA
168901 TTCACTTTCC TCCCTCTGGC TTATTGAATT TTATAATTCT TTATTGTTCA
168951 AGTCCAGTGC ATGCTTCTTG TCTGAGCCTT CCAAACAACT CCAGTTCATG
169001 AGTGTTGCTG TCCTTTGAAC ACTTACTATA TTTTACTATA TAAACTATTA
169051 GATTGTTACA CTTAAACCTG CACTAAAATG TTGTTAATTA ACAATTAACA
169101 TTTTAATTAA TGCTTATTAA CACATGATGT GTAGAGGTGA CAAAGTACTT
169151 TATGACGTTA AAAAAAGGCT TTTAAAGTAA ATGTTTACAC TAACTACCTA
169201 ATAATGAAGT AAAACATAGG TTTTTAACTC TCTTTGCTAT TAAAAAATAA
169251 TTCCAGTAAT CTTACAGTCC AAATTGGATT TTAAAAAGAA TTATGATCAT
169301 CTTTAGACCC AGGAAGGGAA GCCTCTACTC CATGCTAGAG CTTTAGATGG
169351 TCTTGCCCGT TCACTCCTCT GGCTACATTA CCCTTCATGA AGATATGACC
169401 TTGAGGGATA AGAAGATATG CCACTTAGAT CTTATGGTTT ATTTCTATAC
169451 CATAGCACAG GTATTCAAGA CCCTAGACTT TCTTGCTCAA ATGGCCTTAA
169501 GTCTACTTTT AGGAGCTTCA CAGATTCTTC CTGGGATTCA TCCTCCAAAG
169551 GATGTACTGT GACACTGGTG TGCTCAGCCT AAGTTCACTG GAGGACTAAA
169601 GTTGGCAGCT TTTTGAAACA GGGAAAAGAC ACAGCTTGTG TATGAGATGC
169651 TCATATATGT GCATATGTGA AGTCTGTCAG GGTGTGAGAT AGAGCTAGAG
169701 TCAGGTAAGG GCAAAGAAGT GGGATTAACT GAGGTTAAGA GCTGGCTCTC
169751 TATAGGCCAC TACATGCTGC CTAGGGTCTT AGGAGTCCAA GTATTTTAAA
169801 TATGAACCTG GATTGTCAGG TTGTTATGAA AGTATCTTTA CAAAGTAGAC
169851 TGGTACTGTA TATTTTAAGT TTGGTCTAAT TTAAAGAATG GAACTGCAGG
169901 CTATTATCTT AAATGAAACA ACTGACACAT AGAAAGACAA ATACTGCATG
169951 TTCTCATTTA TAAGTGGGAG CTAAATAATG TGCACACATA GATGTACACT

FIGURE 3XX

```
170001 GTGGAATGAT AGACAATGGA GACTTGGAAA GGTGAAAGGG TAAAAGGGGG
170051 GTGGATGATG AGAAATTACT TAATGGTGCA ATGTACATTA TTCCGGTGAT
170101 GAGTACACTA AAGCCCTGAC TTCACCAATA TGCAATATAT TAGTGTAATA
170151 AAATTATACT TGTATTCTAT ACATTTATAC AAGTAACAAA AGATTTATCA
170201 TTTAAAAATA TTAAGGCATG TGGTATGTGA GCTGCCATAC TCATATTCTT
170251 GCCTTGGGAC CCCTACTTTT TAGAGACCCT ATTTAATTTA ATACTTGAAA
170301 TTATAACTAA AAGGTTAAAA TTGACCCCTT GAACAGCATG GAGATTGACC
170351 TCTGTGTTAT TGAAAATCCA TGTATAACAT TTGACTGTCC AGAAAAGTTA
170401 ACTACTAATA GCCTACTGTT TATCAGAAGC CTTGTTGATA ACATAAACAG
170451 TTGATTAACA CATAGTTTCT ATGTTATATA TTACACATAC TGTATTCTTA
170501 CAGTAAAGTA AGCTAGAGAA AAGAAAATGT TATTAATCAT AGCTGGGCAT
170551 GCTGCCTCAT GCCTGTAATC CCAGAAGTTT GAGAGGCCAA GGCAGGTGTA
170601 TCACCTGAGC TCAGGAGTTT GAGACCAGCC TGGGCAACAT GGCAAAATCC
170651 CATCTCTACC CAAAATACAA AAAATTAGCT GGGCATGGTG GTGCATGCCT
170701 GTAGTCCCAG CTACTTTGGA AGCTGAGGTG GAAGGATTTC TTGAGCCTGG
170751 GACATGGAGG TTGCAGTGAC CAAAAATTGC GCCACTTTGC TCCAACCTGG
170801 GTAACAGAGT GAGACCCTAT CTCAGAAAAA GAAAAGAAAA TCATAAGGAA
170851 GAGAAAATAT ATTGACTATT CATTAAATGG AACTGGACGA TCATGAAGTG
170901 GCCTTCATCC TTGTTGTCTT TATGTTGAGT AGGCTGAAGA GAAGGGTAAA
170951 GTGGAAGCAT TGGTCTTGCT GTTTCAGAGG TGGCAGAGGC TGAAGAAAAT
171001 TCATTGTAAG TGGACCTGCA TAGCTTAAAC CTGTGTTCAG GTTTCATCTT
171051 TATATATAAA TGCAGTATTT CCAAAAGGAA AAGTATGCCT GAAATGTGAT
171101 ATAATTTTTA TACCTACTAA TGTTATATTT TATGGCAAAT TCCATAGGCT
171151 TTTAGATCTA TATCAATCTT GAATCTATCT TCTTGTTTTA GGGAATCAGA
171201 TCCAAATTTG TATATCAATA TATATTACTT TCTATATTCT TGAATAAGAT
171251 GAAATTTACC AATTATGTCT GTTTTGAGTG TTTTGGTACC TAAGTCTAAT
171301 TCTAATTTAT TTTAAGTAGA AGAAGAAACA TTATTTTTCA TCAAACATCA
171351 CAAACTCAGT GTAAAAAAAA ATGCATCATT TTGTTATGTA TCCTTATGCA
171401 CTGTATTTGA GAAGAATAAC ATTTCCGATT ACCTGTGTGT ATTTTGTACT
171451 TCTATATTTC TTGGTTTATA TCGGTTCTGA TTAGAGAATA CATATATTTT
171501 TTCACTTCAG ACCCTTCTCT CATTCTGAAC ATCTCCGCAA CTGAATGTAT
171551 TTGTAAATAA GGAAATATTA TAATTTCATA AATGATATTT TCAAACACTT
171601 CTTCATATTT GAGTTAAAGT TAATCTCATA TTTTCAGAGA ATTAATTTTT
171651 TGTTGAACAT GGTTAATGCT TTTTGTTAAT ATGAAGTGAT GAAGATACTA
171701 AAACAGAATT TACAGGGAAT ATAATTCTTT TTTTTTATAC TTTAAAATTT
171751 CTAGGGTACA TGTGCACAAC GTGCAGGTTT GTTACATATG TATATATGTG
171801 CCATGTTTGT GTGCTGCACC CATTAACTCA TCATTTACAT TGGGTATATC
171851 TCCTAATGCT TTCTCTCTCC CCTCCCCCCA CCCCACCACA GGCCCCGGTG
171901 TGTGATGTTC CCCTTCCTGT GTTATCATTG TTCAATTCCC ACCTATGAGT
171951 GAGAACATGC GGTGTTTGGT TTTTTGTCCT TGCAATACTT TGCTGAGAAT
172001 GATGGTTTCC AGCTTCATCC ATGTCCCTAC AAAGGACATG AACTCATCCT
172051 TTTTTGTGGC TGCATAGTAT TCCATGGTGT ATATGTGCCA CATTTTCTTA
172101 ATCCAGTCTA TCATTGATGG ANNNNNNNNN NNNNNNNNNN NNNNNNNNNN
172151 NNNNNNNNNN NNNNNNNNNN NNNNNNNNNN NNNNNNNNNN NNNNNNNNNN
172201 NNNNNNNNNN NNNNNNNNNN NNNNNNNNNN NNNNNNNNNN NNNNNNNNNN
172251 NNNNNNNNNN NNNNNNNNNN NNNNNNNNNN NNNNNNNNNN NNNNNNNNNN
172301 NNNNNNNNNN NNNNNNNNNN NNNNNNNNNN NNNNNNNNNN NNNNNNNNNN
172351 NNNNNNNNNN NNNNNNNNNN NNNNNNNNNN NNNNNNNNNN NNNNNNNNNN
172401 NNNNNNNNNN NNNNNNNNNN NNNNNNNNNN NNNNNNNNNN NNNNNNNNNN
172451 NNNNNNNNNN NNNNNNNNNN NNNNNNNNNN NNNNNNNNNN NNNNNNNNNN
172501 NNNNNNNNNN NNNNNNNNNN NNNNNNNNNN NNNNNNNNNN NNNNNNNNNN
172551 NNNNNNNNNN NNNNNNNNNN NNNNNNNNNN NNNNNNNNNN NNNNNNNNNN
172601 NNNNNNNNNN NNNNNNNNNN NNNNNNNNNN NNNNNNNNNN NNNNNNNNNN
172651 NNNNNNNNNN NNNNNNNNNN NNNNNNNNNN NNNNNNNNNN NNNNNNNNNN
172701 NNNNNNNNNN NNNNNNNNNN NNNNNNNNNN NNNNNNNNNN NNNNNNNNNN
172751 NNNNNNNNNN NNNNNNNNNN NNNNNNNNNN NNNNNNNNNN NNNNNNNNNN
172801 NNNNNNNNNN NNNNNNNNNN NNNNNNNNNN NNNNNNNNNN NNNNNNNNNN
172851 NNNNNNNNNN NNNNNNNNNN NNNNNNNNNN NNNNNNNNNN NNNNNNNNNN
172901 NNNNNNNNNN NNNNNNNNNN NNNNNNNNNN NNNNNNNNNN NNNNNNNNNN
172951 NNNNNNNNNN NNNNNNNNNN NNNNNNNNNN NNNNNNNNNN NNNNNNNNNN
173001 NNNNNNNNNN NNNNNNNNNN NNNNNNNNNN NNNNNNNNNN NNNNNNNNNN
173051 NNNNNNNNNN NNNNNNNNNN NNNNNNNNNN NNNNNNNNNN NNNNNNNNNN
173101 NNNNNNNNNN NNNNNNNNNN NNNNNNNNNN NNNNNNNNNN NNNNNNNNNN
173151 NNNNNNNNNN NNNNNNNNNN NNNNNNNNNN NNNNNNNNNN NNNNNNNNNN
173201 NNNNNNNNNN NNNNNNNNNN NNNNNNNNNN NNNNNNNNNN NNNNNNNNNN
173251 NNNNNNNNNN NNNNNNNNNN NNNNNNNNNN NNNNNNNNNN NNNNNNNNNN
173301 NNNNNNNNNN NNNNNNNNNN NNNNNNNNNN NNNNNNNNNN NNNNNNNNNN
173351 NNNNNNNNNN NNNNNNNNNN NNNNNNNNNN NNNNNNNNNN NNNNNNNNNN
```

FIGURE 3YY

173401 NNNNNNNNNN NNNNNNNNNN NNNNNNNNNN NNNNNNNNNN NNNNNNNNNN
173451 NNNNNNNNNN NNNNNNNNNN NNNNNNNNNN NNNNNNNNNN NNNNNNNNNN
173501 NNNNNNNNNN NNNNNNNNNN NNNNNNNNNN NNNNNNNNNN NNNNNNNNNN
173551 NNNNNNNNNN NNNNNNNNNN NNNNNNNNNN NNNNNNNNNN NNNNNNNNNN
173601 NNNNNNNNNN NNNNNNNNNN NNNNNNNNNN NNNNNNNNNN NNNNNNNNNN
173651 NNNNNNNNNN NNNNNNNNNN NNNNNNNNNN NNNNNNNNNN NNNNNNNNNN
173701 NNNNNNNNNN NNNNNNNNNN NNNNNNNNNN NNNNNNNNNN NNNNNNNNNN
173751 NNNNNNNNNN NNNNNNNNNN NNNNNNNNNN NNNNNNNNNN NNNNNNNNNN
173801 NNNNNNNNNN NNNNNNNNNN NNNNNNNNNN NNNNNNNNNN NNNNNNNNNN
173851 NNNNNNNNNN NNNNNNNNNN NNNNNNNNNN NNNNNNNNNN NNNNNNNNNN
173901 NNNNNNNNNN NNNNNNNNNN NNNNNNNNNN NNNNNNNNNN NNNNNNNNNN
173951 NNNNNNNNNN NNNNNNNNNN NNNNNNNNNN NNNNNNNNNN NNNNNNNNNN
174001 NNNNNNNNNN NNNNNNNNNN NNNNNNNNNN NNNNNNNNNN NNNNNNNNNN
174051 NNNNNNNNNN NNNNNNNNNN NNNNNNNNNN NNNNNNNNNN NNNNNNNNNN
174101 NNNNNNNNNN NNNNNNNNNN NNNNNNNNNN NNNNNNNNNN NNNNNNNNNN
174151 NNNNNNNNNN NNNNNNNNNN NNNNNNNNNN NNNNNNNNNN NNNNNNNNNN
174201 NNNNNNNNNN NNNNNNNNNN NNNNNNNNNN NNNNNNNNNN NNNNNNNNNN
174251 NNNNNNNNNN NNNNNNNNNN NNNNNNNNNN NNNNNNNNNN NNNNNNNNNN
174301 NNNNNNNNNN NNNNNNNNNN NNNNNNNNNN NNNNNNNNNN NNNNNNNNNN
174351 NNNNNNNNNN NNNNNNNNNN NNNNNNNNNN NNNNNNNNNN NNNNNNNNNN
174401 NNNNNNNNNN NNNNNNNNNN NNNNNNNNNN NNNNNNNNNN NNNNNNNNNN
174451 NNNNNNNNNN NNNNNNNNNN NNNNNNNNNN NNNNNNNNNN NNNNNNNNNN
174501 NNNNNNNNNN NNNNNNNNNN NNNNNNNNNN NNNNNNNNNN NNNNNNNNNN
174551 NNNNNNNNNN NNNNNNNNNN NNNNNNNNNN NNNNNNNNNN NNNNNNNNNN
174601 NNNNNNNNNN NNNNNNNNNN NNNNNNNNNN NNNNNNNNNN NNNNNNNNNN
174651 NNNNNNNNNN NNNNNNNNNN NNNNNNNNNN NNNNNNNNNN NNNNNNNNNN
174701 NNNNNNNNNN NNNNNNNNNN NNNNNNNNNN NNNNNNNNNN NNNNNNNNNN
174751 NNNNNNNNNN NNNNNNNNNN NNNNNNNNNN NNNNNNNNNN NNNNNNNNNN
174801 NNNNNNNNNN NNNNNNNNNN NNNNNNNNNN NNNNNNNNNN NNNNNNNNNN
174851 NNNNNNNNNN NNNNNNNNNN NNNNNNNNNN NNNNNNNNNN NNNNNNNNNN
174901 NNNNNNNNNN NNNNNNNNNN NNNNNNNNNN NNNNNNNNNN NNNNNNNNNN
174951 NNNNNNNNNN NNNNNNNNNN NNNNNNNNNN NNNNNNNNNN NNNNNNNNNN
175001 NNNNNNNNNN NNNNNNNNNN NNNNNNNNNN NNNNNNNNNN NNNNNNNNNN
175051 NNNNNNNNNN NNNNNNNNNN NNNNNNNNNN NNNNNNNNNN NNNNNNNNNN
175101 NNNNNNNNNN NNNNNNNNNN NNNNNNNNNN NNNNNNNNNN NNNNNNNNNN
175151 NNNNNNNNNN NNNNNNNNNN NNNNNNNNNN NNNNNNNNNN NNNNNNNNNN
175201 NNNNNNNNNN NNNNNNNNNN NNNNNNNNNN NNNNNNNNNN NNNNNNNNNN
175251 NNNNNNNNNN NNNNNNNNNN NNNNNNNNNN NNNNNNNNNN NNNNNNNNNN
175301 NNNNNNNNNN NNNNNNNNNN NNNNNNNNNN NNNNNNNNNN NNNNNNNNNN
175351 NNNNNNNNNN NNNNNNNNNN NNNNNNNNNN NNNNNNNNNN NNNNNNNNNN
175401 NNNNNNNNNN NNNNNNNNNN NNNNNNNNNN NNNNNNNNNN NNNNNNNNNN
175451 NNNNNNNNNN NNNNNNNNNN NNNNNNNNNN NNNNNNNNNN NNNNNNNNNN
175501 NNNNNNNNNN NNNNNNNNNN NNNNNNNNNN NNNNNNNNNN NNNNNNNNNN
175551 NNNNNNNNNN NNNNNNNNNN NNNNNNNNNN NNNNNNNNNN NNNNNNNNNN
175601 NNNNNNNNNN NNNNNNNNNN NNNNNNNNNN NNNNNNNNNN NNNNNNNNNN
175651 NNNNNNNNNN NNNNNNNNNN NNNNNNNNNN NNNNNNNNNN NNNNNNNNNN
175701 NNNNNNNNNN NNNNNNNNNN NNNNNNNNNN NNNNNNNNNN NNNNNNNNNN
175751 NNNNNNNNNN NNNNNNNNNN NNNNNNNNNN NNNNNNNNNN NNNNNNNNNN
175801 NNNNNNNNNN NNNNNNNNNN NNNNNNNNNN NNNNNNNNNN NNNNNNNNNN
175851 NNNNNNNNNN NNNNNNNNNN NNNNNNNNNN NNNNNNNNNN NNNNNNNNNN
175901 NNNNNNNNNN NNNNNNNNNN NNNNNNNNNN NNNNNNNNNN NNNNNNNNNN
175951 NNNNNNNNNN NNNNNNNNNN NNNNNNNNNN NNNNNNNNNN NNNNNNNNNN
176001 NNNNNNNNNN NNNNNNNNNN NNNCTGCCCT TAACATTTTT TCCTCCATTT
176051 CAACTTTGGT GAATCTGACA ATTATGTGTC TTGGAGTTGC TCTTCTCGAG
176101 GAATATCTTT GTGGCATTCT CTGTATTTCC TGAATTTGAA TGTTGGCCTG
176151 CCTTGCTAGG TTGGGGAGGT TCTTCTGGAT AATGTCCTGC AGAGTGTTTT
176201 CCAACTTGGT TCCATTCTCC CCATCACTTT CAGGTACACC AATCAGATGT
176251 AGATTTTGTC TTTTCACATA GTCCCATATT TCTTGGAGGC TTTGTTCATT
176301 TCTTTTTATT CTGTTTTCTC TAAACTTCTC TTCTGACTTC TTTTCATTCA
176351 TTTGATCTTC AATCACTGAT ACCCTTTTTT CCAGTTGATT GAATCAGCTA
176401 CTGAAGCTTG TGAATTCATC ACATAGTTCT CATGCCATGG TTTTCCACTC
176451 CATCAGGTCA TTCAAGGACT TCTCTGCACT GGTTATTCTA GTTAGCCATT
176501 CATTTCATCT GTTTTCAAGG TTTTTAGCTT CTTTGCGATG GGTTCTAACT
176551 TCCTTCTTTA GCTCGGAGAA GTTTGATTAT CTGAAGCCTT CTTCTCTCAA
176601 CTCGTCAACG TCATTCTCCG TCCAGCTTTT TTCCGTTGCT GGCGAGGAAC
176651 TGCATTCCTT TGGAGGGGGA GAGGTGCTCT GGTTTTTAGA ATTTTCAGCT
176701 TTTCTCCTCT GTTTTTTTCC CATCTTTGTG GTTTTATCTA CCTTTGGTCT
176751 TTGATGATGG TGACGTGCAG ATGGGGTTTT GGTGTGGATG TCCTTTCTGT

FIGURE 3ZZ

176801 TTGTTAGTTT TCCTTCTAAC AGTCAGGACC CTCAGCTGCA GGTCTGTTGG
176851 AGTTTGCTGG AGGTCCACTC CAGACCCTGT TTGCCTGGGT ATCTGCAGTG
176901 GAGGCTGCAG AACACCGAAT ATTGCTGAAC AGCAAATGTT GCTGCCTGAT
176951 TGTTCCTCTG GAAGCTTCAT CTCTGAGGGG TACCTGGCCG TGTGAGGTGT
177001 CAGTCTGCCC CTACTGGGGG GTGCCTCCCA GTTAGGCTAC TTGGGGGTGT
177051 GGGACCCACT TGAGGAGGCA GTCTGTCCAT TCTCAGATCT CAAAATCCAT
177101 GCTGGGAGAA CCACTGCTCT CTTCAAAGCT GTCAGACAGG GACATTTAAG
177151 TCTGCAGAGG TTTCTGCTGT CTTTTGTTTG TCTATGCCCT GCCCCCAGAG
177201 GTGGCGTCTA CAGAGGCAGG CAGGCCTCCT TGAGCTGGGG TGTGCTCTAC
177251 CCAGTTCCAG CTTCCCCACT GCTTTGTTTA CCTACTCAAG CCTCAGCAAT
177301 GGTGGGCGTC CCTCCCCCAG CCCTGCTGCC TTGCAGTTTG ATCTCAGACT
177351 GCTGTGCTAG CAATGAGCAA GGCTCCGTGG GCATGGCACC CTCTAAGCCA
177401 GGTGTGGGAT ATAATCTCCT GGTGTGCCAT TTGCTAAAAC TGTTGGAAAA
177451 GCACAGTATT AGGGTGGGAG TGACCCAATT TTCCAGATGC CATCTGTCAC
177501 AGCTTTGCTT GGCTATGAAA GGGAATTCCC TGACCCCTTG CGCTTCCTGG
177551 GTGAGGCGAT GCTTCGCCCT GCTTTGGCTC ACACTCAGTG GGCTGCACCC
177601 ACTGTCCTGC CCCCACTGTC TGACGAGCCC CATTGAGATG AACCCGGTAC
177651 CTCAGTTGGA AATGTAGAAA TCACCCGTCT TCTGTGTCGC TCATGCTAGG
177701 AGCTGTAGAC TGGAGCTGTT CCTATTCAGC CATCTTGGAA ACACCCCCCG
177751 GAATATAATT CTTTACTCCT ATATGGGAGA GTAAAGGATG TAGTATAGAC
177801 ATTAATAATA ATGTATATGC ATTCCCTGAG AAGTGAAATC AATTGTAATT
177851 ATAAATATAT TCAAAATAAA AATCATCATT GGATGAGTAC TTTAGATTCT
177901 TTCCTATGAG TAAAATACCT AGATTTTTAG ACATTGATTT TGACAGTTTA
177951 AAATTATATC ATATTTTTTA CTATTATCTT GGTTCACAGT TATATTTAGA
178001 ATGATTATAT TGTGGTTCCA ATGAGCTGTG ATAGTGCTGG TTTGCCTTTA
178051 AGTGTCCTCA GAGTAACATA AGACCCATTA TACATTAGGA TGAAAGGCAT
178101 TTAGATGGGA AATATCATGT ATATTCCCAT GAGATTTTTG AATCACCCCT
178151 GGTAAAAAAT GTGTGTATTT TGTAAAATTA AATATACAAT TCAAAGGAAC
178201 TCATTGTTTT CTCTGGAAAA TGCCCTCTGG ATTTCAAGCA AGAAATTTGC
178251 AGAAAATATT TTTTGGATAA AGATTGTGTT AAGTTTGCAT GATGGATAAT
178301 ATAAATTATT CTGGAAATTT ACTGTAGATA ATTAAAAGTA CTTTGTGTCA
178351 TAATAGTGCT GTATACTGAG GAAAATAGGC ATTCTGTTAG AAACTATACT
178401 ATACTAGTGA AACTCAACCA GCCTTGATTT AGTAACTCTC TATAGCCAGT
178451 TAAAATAAGA AACTGCAAAC AGAATGTGTT AAATAATCTT ATTATAAATA
178501 ACTGAAGTAT GTTATCAACC AATAGAACCC TTATTCACTA TAGCAAACCA
178551 TTTGTTGTTT TCAGTATACT CTAATAGAAA TGATAAACTA TGATGCCTAG
178601 CATGTTTTCC CAAAAATGCC ATAAGGTTAC CTGAATGTTT TTCTTGTATT
178651 GAAAATGATC AGTTATAGCT ATACAAATAA AATGGAGTTA TAATCTAAAT
178701 TTACAGTATA GAAGTATGCA ATATTAAATG AATAAATATT GATAATATAA
178751 ACTGCTTTCA GGGTACCCAA ATATTTTTAT TAAATCCCTT AAAAATGGAC
178801 AAAGTCTTTC TATGCAATCA AGTGGCAAAC TGCTTGTACA TAAACATACA
178851 GAAGTGAAAA TAATCCAGTG ATCTAGCTCA GAGTAAAAGC CAAAGGGCTT
178901 AAAATGCTTA ATAAAGACTT TTGGTTTGGC TGCTCTCTGA CTGTCTGTTC
178951 TTATTACCTA ATGTGCTTTC AGTGCCCACT TATGCTCTTC CTCAAATATA
179001 CCTGTACAGT CTTGCCTCAG GTTATTTGTA TTTACTGCTT CCTCTTTGCA
179051 AGTTTCACTA TCTCATCTCT AAGGCAATGC GTAAATGTCA CTACCTCAGT
179101 AAGGCCTTTT CTAGCCACCC ACTTAAAATT ATAACCCTCT TCTTAATCTC
179151 CTTGACCTGT TTTTCCCCAT TGTACTTTCT ACCATATTAT TTAGTTTTAT
179201 TCATTTCTAC TTTTTAATTG TCTCTCTTCC CTCCAAAGTA AGCTTTATAA
179251 AGGCAGAGAG TTTTTGTTCA GCTTGTTAAC TGCTGTATTT CCAGTGTCCA
179301 GGGTATGGGA ATGCCTGATA AATATTTATC GAATAAGCCT AAGGCCTTAT
179351 CCATGTCTGT TTGCTATTGA AGTAGTCATA TAAATATTTA ATTGACTATT
179401 GGCAAAGAAA ACACACCACA ATTTGTGGCA AATTGGATAT AAGGAAAGAT
179451 GGGAAACCCT AAGTGCGTTT TTTATATATT TAGTTGTTCT GATAAGATAA
179501 TGGATGCTAT TTAATGTTCT TATAGTATGC CAGGAACTAT CTGAAGTGCT
179551 GTACATGTAT TTATCTAATT TACACCTTAC AACAACCCTG TGAAACAGGT
179601 ACTATTATCA GCTCCTTTAC AGTTGAGGAA ACTAGTGATC AAATAAAGTT
179651 GTCATGCAAT TAATGTGTAG GAAGGCAAGA CAGGACAGCT GATTCTAGAA
179701 CCTGTACTTT TAACTAAAGG CTCATGGTTA AAATGCTGTT CCATTGATAC
179751 TTTGAGTAGC TTCATTTGTA TCCTTTTAAT TCATTTTTAT TTTGGTAAAA
179801 CAAAAAAAAT TGTAAGTAAT CATTTCTGTT TAATCACTGT GGTTTAAAAT
179851 CACTTAATTA CTTTTTTCCC TTTTTGCAGT GGGATGCCAT CACTGAAATG
179901 GATGAACATA ATAGGCCCAT TCACACATAC CAGGTATGTA ATGTAATGGA
179951 ACCAAACCAA AACAACTGGC TTCGTACAAA CTGGATCTCC CGTGATGCAG
180001 CTCAGAAAAT TTATGTGGAA ATGAAATTCA CACTAAGGGA TTGTAACAGC
180051 ATCCCATGGG TCTTGGGGAC TTGCAAAGAA ACATTTAATC TGTTTTATAT
180101 GGAATCAGAT GAGTCCCACG GAATTAAATT CAAGCCAAAC CAGTATACAA
180151 AGATCGACAC AATTGCTGCT GATGAGAGTT TTACCCAGAT GGATTTGGGT

FIGURE 3AAA

180201 GATCGCATCC TCAAACTCAA CACTGAAATT CGTGAGGTGG GGCCTATAGA
180251 AAGGAAAGGA TTTTATCTGG CTTTTCAAGA CATTGGGGCG TGCATTGCCC
180301 TGGTTTCAGT CCGTGTTTTC TACAAGAAAT GCCCCTTCAC TGTTCGTAAC
180351 TTGGCCATGT TTCCTGATAC CATTCCAAGG GTTGATTCCT CCTCTTTGGT
180401 TGAAGTACGG GGTTCTTGTG TGAAGAGTGC TGAAGAGCGT GACACTCCTA
180451 AACTGTATTG TGGAGCTGAT GGAGATTGGC TGGTTCCTCT TGGAAGGTGC
180501 ATCTGCAGTA CAGGATATGA AGAAATTGAG GGTTCTTGCC ATGGTAAGAA
180551 ACAAACATTT AAATAATTTA TCTTGCATTT AAATGATTTT AAAAAAGTTT
180601 TATTTTTTAA ATTAACAAAT AGTAATTGTG CATATTCATG GGTGTGTAGT
180651 AATGTTTTGA TACATATAAT GTATACTGAT CAGATCAAAG TAGTTAATAT
180701 ATCCATCATC TCAAACACTG ATCTTTTCAA AATGACGATT TATTAAAAGT
180751 AAATATTATA CATTTATTTC AAATAATACA TTTTTGAGTG GTATACTTGA
180801 TAATTAATTG TGAAAGCAAT TGATTCATAT TAACCATAAG AAAATTTCTG
180851 TCATTTTTCT CCTGGGAAAG GTGTATGAAA TTGTGCCAAA GTGCTTTCAG
180901 TAAAGTCGTT AAACAATATG AATTGCTGTA TCCGCCTAAT TTTTATAAAG
180951 GAAAGCAGCA TCAACAACAG CAACAAAAAG CAATGAGATT CAAAATAGTG
181001 ATTTCCCTGG TGTTCACATT TTTACAGTTT ATAGAAATAT GACATTTAAA
181051 GACAGCAATA ATTATTTCTA TCATATTGAA TTATAATACT TGAATTGTAC
181101 TTAAATAGAA TTATATTTAA ATAAATGAGG GATTCATGTA TATTTTATTT
181151 CAAAAATGTA TAAGCTAGTT TATATGGGTG TTATGTATGA TGTTTGGTGG
181201 TTGAATATTG ACCTGATCAG AGCTTAATTA ATCTTTTGCT ATTATTACAT
181251 AGAATTTTTC ACCATATAAC ACATTAGCTT TTCATTTTAA TAGTAGTATT
181301 TATGTGACAT CTAATTGTCA GGAAATGTTA ACATCGCAAA ATGCTAGTTA
181351 AGTTTAGAAC TATACCTTTC ACATTGTTTT AACAATGAAA TACCTATAAT
181401 TTTCGTGATG AAACATTTTT CACTTTTTAT GTAATTCATT TTATGAAGGC
181451 TTATTTACCT AATAAGTATA TACATTCAAA AATTTTATAT ACCCCCTAAT
181501 AAAGAGCATA CGTTTGATTA TAATTAGATT TAGGACTCAT AATCAAAACA
181551 CAAATATAGA AAAAAAATTA TTTCATGGTA AATAGTAATA TACCGGAGAT
181601 ATTTCCCTCT CAATGATAAC TTCTTAAGAG GGTGTTTTCT ACAGCACCAG
181651 CTTGAGTTTA TTGATTTCTT TGTTGATGTT ATATTCACAT TCATTAAAAA
181701 GGATGAGAAT AAATAAGAAA AACATCTGTA TGCATATAAT GGTCATGGAT
181751 AATATATGTG AAGTTTTAAA GGTTTTTTCT GTTTATAAAA CACTTGGGTT
181801 CTTGACTCTT TAGAAGTTCG CTCAAGCTGC CAGTGATGAT TATGTTTTGT
181851 AACTGGAGAA TACTAATATT TGCATGAGAA GTCGGTAGTA TATATTTTAC
181901 AAAGCATGAA TCAGCTTTCC TGTGCTTTTA ATCATTAAAG TATGTTTCAT
181951 TCAAGTTTAG TAATATAGGT TATCAATATA GTTTATCAAA ATTTTTATTC
182001 ACTTATAACA AGGATTTATA ATGGAGAAAA ACCATAAATT ATCCTGGAGT
182051 TAGGATCTAA AGATATTTTA CATTGGAAAG TGCATGTATT AGTTTGTTCT
182101 CATACTGCTA TAAGAACTTC CTGAGACTGG GTAATTTATG AAGGAAAGAG
182151 TTTTAAATGG CTCACACTTC CACAGGCTTA ACAGGAAGCA CTACTGGAAC
182201 ACCTCAGGAA ACTTACAATC ATGGCAGAAG GCGAAGGGGA AGCATGTATG
182251 CCTTACCCTG GCAGCAGAGG AGAGAGAGAG TGAAAGGGGA AAGTGCCACA
182301 CACTTTCAAA CAACCAGATC TCATGAGAAC TCACTATCAT GAGAACAGCA
182351 AAAAGGAAGT CCACCCCCAT GATTCAATCA CTTCCCACCA GGCCCCTCCT
182401 CCAGAATTTC AAGATGAGAT TTGGGTGGGG ACATAGACAC ACCATATCAG
182451 TGCACTAAAG AAAAATTTAT ACATATGAAT AATTATCCAG TTAAGTGGAG
182501 AAGACAATAA GATCTAAGGA TAAAATGTAT TACACAGAGT AACCATGTAG
182551 TGTTTTTGGT ACAGACATGT AATATGTGTA ATAATCACAT CAGTTTTACC
182601 ATATTTTAAA TTAGGTAGAA AGCCATTACT TGGTAAAAAA AATACAGTTT
182651 TTTAAATATT TGAAGAATTA TTTAATCTAA GAATTTATGT GATTTGCTAT
182701 TACTAAATAT TTGTATTTCT TTATGGCATT TACCACAGAA TTAAAGTAAC
182751 CAACCGTGAT GTCTAGATTT TTTTTTACTT AATATGCTTG CTGTGAAATT
182801 TTATTCTTAT TTATATGCCT GCAAATTTCT TCTATGATTT GGCAAAGATA
182851 GTTTTGGACA AATGATAAGC AGCATCTGTT TATCTAGAGC TTCTACTTGT
182901 GTGTTTTTAT GGCTTGTTAT CTTTATTATC CTTTATCTGA TTGCAGAAAC
182951 ATGAGGGAGT CAGTACAGAA CAATTGTTCA TCACCTTGTA GTGGATGGCA
183001 GAAATTGGAA GATTTAAGTT TGAATTCTAT ATCTATGGCT TACAAACCTC
183051 AAAATCAGGT GTTTTTTTTA AATTTATAAA GTAGTGGTTA TAATCACCTA
183101 AAGATGAAAT ACATGTAAAA CTATTAACAA CAAGCAAACA TGCCTGATTC
183151 TAATTAAATA TAATGAATTG CTATTTATAA ACAAAAGAAA TGTCAGAGTG
183201 GATGTGGAGA CTACATTATT TTAAAGATAT ATATAGTGCA CTACCACCAG
183251 TGTTCATTTT AGAGTACTTA CTTTTATGTG TGTTCTTGAT GTTGTGTGTT
183301 GCCCCTTTCT TTCCTCTGAT GAGAATTTTA TCATTGCTTT TATTGCCATC
183351 TATTCATAAC TTTTCTCACA AAAAAAATCT CTGAATTACA TATAATCAAA
183401 AGGTCAAACT AATTCAAACT TATATGAAAA AACTGTAGTA CAAGTAGAAA
183451 AGTGACCACA TATATAATAG GAAAAGAAAA AATGAGTATA TCACTATTTT
183501 TCTTCTTGTC TATTCTGTGT AAACAATTAA TTAATCTACA GTATTGATTT
183551 TTTTTTAGAG ACAGGGTCTT ATTCTGTCAC CCAGGCTGGA GTGCACTGGT

FIGURE 3BBB

183601 GCGACCATAG CTCATTCCAA TCTTGAACTC CTAGGTTCAA GCGATCCTCC
183651 TGCCTTAGCC TCCCAAAGTG CTGTGATTGC AGGGGTGAGC CACTGCTTCC
183701 AGCCCCAAAC TATTGATATT TTTGAGCATT TACTATTTCT TAATCACTTT
183751 CTTAAGTGGT AGAGATAAAC ATAAATAAGG CATATGTTTC TGTTATTCAT
183801 TGCTATGAGA CAAAACAGCC CAAAATGTAT TGGCTTAAAA CCACAATGAT
183851 TTATTATTTT TCAGGGCTCA GCTAGTAGTT CTGCTTAATG TACAATAAAC
183901 AGCCATCACT TATGTAGCTG AATTCCACTG GGAGCTTGAC TTGAGTTGGA
183951 ATGTCCAAGA TAGCNCCCTC ATCTTCCAGG GCCTTTCTCT ATGTGGCCTC
184001 TCATCATTTA GTATCTATCC CAAGCTTTCC TGGAGCGTAG TTGCTGGCTT
184051 AAGAGGGAGT TTATTCACAT AACCATCTGT AAAATGAGTA TCCGAGGAGA
184101 TAGCACAAGA GTGAATACCT GAAAGTTTAT TTATAGGGGA CTGCCACCAT
184151 GACAATACAT TATTTTACAG TCTTCTCTCT GGATTCTCCT GATTAATGTC
184201 CCTTCGTCAT GCACAAAATC CCACACCCTC CCAAAGGTTT ATCACATTAG
184251 GACATCATGT TGAAGTCCAA TATAGCATGT TGAAATCAGT TCCAGATTCA
184301 AATGAAGTTT CGTTGCTAAA ATCCCTGTTG ATCTGCAGAA CTAAGAACCT
184351 AAAAATAAGT TATGGTTCCT TACACACACA ACACACATGG AACAGGGGCA
184401 GGATAATTGG AAAATTTTCT CCCATTCCGA AAGGCAGGGA ACACAACAGT
184451 CACTGGTCCA TTGTGATTGT GAAGTGCAAC TGGTGTTTTC AAGGTCCCTG
184501 ACTGCAGGGG CAGAGAATGT TTTCTGATTA GAGCCCAGTT CTGCTCCCTG
184551 TGATTGGTTC CCTGTGTCTT TTGGCTTTCT TACTAGTATC TTGCCGCTGC
184601 ACTCTTAGTC ATTCACTCTG TTTATAAGAA TTGCAACTAG CAACATGCTA
184651 GTTGCTAGTT TCAACAGCTG TCTGGAAACC TCTTTAATTT GATCAACAAC
184701 GTTATGAAGT GGTTTTTCTC TCTTCCAAGC TATCACAGGC AGGATTATTG
184751 CCAATTGCTC AGTACATAAC ATGTGTTGAC CTTTTAGTAT CCCCATTAAC
184801 AATTTCTTTA CTGATCTTCC AGCCTCTACT CACAATCTCC ATGCTATTCT
184851 TCAGCTTCTA CCATCTGTTC AATCCCAAAG CAAATATCAC AAGTTTTAAC
184901 TTTTTGTTAC GGCAACACCC AGTTATTTGC TTACAGTTTC TACAATCTGG
184951 AAATCTGGAT GAGGTTCACT GGGTCATTCT TTTCCTGTCT TATCTGAGGT
185001 CACTCATGCA ACTGCAGTTA TTTGGAGGTT TAACAGAGCT GCATGTCTAA
185051 GATGGCTTCA CTCATGTATA ATGCTTCATC TGTTGTGTCT GAGGTAACGT
185101 TGTGTACTGT CTAAATCCTG GTAACAATTT TAGTATGTTT TATTTCAGGA
185151 AATTATTCTA GTTTTTTTTT TCTTTCTGAT ATATTGATTC TAAGGGGTTA
185201 CTCACCTTAG CATTCAAGGA ATTGTACATT TTGACCTTGT CCTGTTCTTT
185251 TGTAACCTCA GCAAATTCTG TCCACTATTC TGGTTTTTAT AATTTTTGAA
185301 CAATCCATGC GTTTTTGTAT CTCTTACCTT TTTTCATATT TTACCTAGCT
185351 GCTTTTGTAC CCTTTTCTTC TTTTTCTGTG ATGAAATTGT ATTTATTCTT
185401 CAAGACCTAA CACCAATGTC ATGCCTCTGG GTCTTCACAA AGTTATTATC
185451 ACTCTCCTCT GTGCTACAAT TTGTGCTAAT TATTTGTGTA TCTGTTTCAC
185501 TAGGGCTGTC AGATAAAAGA GGTGTACTTA AAAAATCACA TGATGTGAAT
185551 GATCACAAAG CACTGAGTAG TTAAAAGTGC AGCCTGTTGG TGCTCCTGTG
185601 GAATGCTCTG TTTCTTCTCA TTTCTGTGAA ATAAGTAAAT TTTCTTGAGG
185651 GAGAGTTGTA GTATTTTAGA TCTGGAAGGC CTTAGAAAAT ATTTTTATCC
185701 ATCATTTTAT GAATCAGGAC ACTAAATTAC TGAGAACAGA ATTTAATTTC
185751 CTGGGGCCAC ACAGTCGTAA CTAATGTTAG ATTGAGAACA AAGCCCAAAT
185801 ATGTCTTAAT CTGGCCTTTA TATGTTTCCC TTCCACCTAT CCCCCATTCT
185851 TTTTTTTTTT TTTAATGAGA CAGAGTCTCT CTCTGTCACC AGGCTAGAGT
185901 ACAGTGGCGC GATCTTGCCG CACTGCAACT TCCGCCTCCT GGGTTCAAGC
185951 GATTCTCAAG CCTCAGCCTC CTGAGTAACT GAGATTTGTT GGACAGGATA
186001 GTCTCAATCT CCTGACCTCC TGATCTGCCT GCCTCGGCCT CCCAAACTGC
186051 TGGGATTACA GGCATGAGCC ACTGCTCCTG GCCCCCACTA TTCTTTCTCA
186101 CTCTTTCATT TCCTCATTCC AGACATCTAT GCCCTCACTT TGAAATGCTT
186151 CAATGTTTGC TGCCTGCCAG ACCCAAAGCA CAGGAGCCCT AAGTTTCTCA
186201 TTATTAATTA GGCCTGCTCT GCCTTCTATT TCTCTTCAGG AGTCTAATGT
186251 GGACACTGCT GGAGCAAGAT TTAAGCATCA CTTTTGAAAT TCATGCTGCT
186301 GAGGATGATG AAAATATATA TAGATATGGA TTCATCTGGA ACTTTGCTTT
186351 TAGAGATGAT AAACAGGAAA AATTACAGTG AGGCTTTAGG GATTTTTGTA
186401 ATTTGCTTGA ATGAATTTGA GACCTCTTGG TCAGCTATGC AACTAAGACA
186451 CAATAAGCTG ATTTAAAATA GAATAAATCT GTATCTAGTC ATACTCCATA
186501 TCTACTGAAT GATGTATATT TAAATTGATG TATATTTAAA TTGCATTTAA
186551 ATAACTTGTT ATGATATTTT ATCCAAAAAG TCGTACTACT GAATGTTTGA
186601 ATTTGTGATT CCTTTTTGCA TAATATTGTT AAGGCTTACC TGTATCCAAA
186651 TTCTAGAAGC ACAAAAGAGG GCAGTAGACT TTTACTCTTG CTGTATGAAC
186701 CAGGCTTAAA TAGATAGAAA GATTATATTA AGCATGTTTG CTAAAATTTA
186751 AAAGCAAACA CGAATAATTT GGGTTGCTTT ATTATACATA GTAAGCAGTA
186801 TTTTAGTCCT CTTTCAAATC TCAGCTGATA TTTCATAACT TTTAATTTTA
186851 TTTCATAGAT TCATAATTAA GACTGTCATA TTGGACATGT TGATGTTACA
186901 GATTTAACAT TGTTTTAATT TATTCTACTT AATGTCAGAC TTTTCTAAGG
186951 TTTTGAATTT AAAAATAACA TTGATTTGCA AAGTATTATG CTAATTTACA

FIGURE 3CCC

187001 TCAAATGGTC TTTCAGTTTA TATGTCTAGG ACTATTTTAG CACTATGGAA
187051 GAAATAATTG GAAACAACAT GCAAAATTGA ATGCAATTTT TGTTTAGTTA
187101 TACGAGTTCT GAAGTAGCAT GAATCCCTAA TAAGCTCCTC TTAAACATTA
187151 ATTTAGGATG AATCTCATTA AGGTAGTGGT ACTTGTACTT AGAGATATTA
187201 GTTTGTGTTT AAAATTTTAG ACCTGCTGAG AATGTGTGTG TGTATGTGTG
187251 TGTGTGTGTG TATATATATA TATATATAGA GAGAGAGAGA GAGAGAGAGA
187301 GAGAGAGAGA GAGAGAGCGA GCTATATATA TACCTACAGG CTGAGAATAT
187351 GTGTGTGTAT ATATATATAT ATATATAGAG AGAGAGAGAG CTATATATAC
187401 CTACAGGCTT AAAGAAGGTA TTATTGCTAT ATATATATAT GTATCACTCA
187451 GTATAACTTA ACTAAATACT ATTTGTCTAT GAAAATTAAA ATTGTGAAAC
187501 ACTAGGCATA ATTAAAAACC TTTCTTCTGC CTAGAAATAT GCTTTAAAAC
187551 TTTTTTTCTA GTAGTGCATT AAAATTCAGA AGGAAAGGAT GCTGGCAATT
187601 CTCGGACCAT TGCATTATTG TTCACGAAGG TAAATGGGAT ATACAGGGCC
187651 TTTAGTGACA TTGTATTGAT TTGATCTCTT GAAGAGTGTT GTTATTAAGG
187701 CTTCATGGCG CAATCCTCTG CTGCAGTTCA GAAACATTTA TGCTGTGTGT
187751 TTATGATCTT CTGTCTAATC ATGTTATCAG AGATGACTGT GCAAGCAGAG
187801 AGCATAAAGA AATATGAGAT ACCAGGATTT GCTGGCATTA AATAAGGGAG
187851 TTTGAGGATA TGATGAAAAG CTGAAAGGTA AGATTGGGAT CAGAAAAAAA
187901 GGGCAGATTT ATTGGCTCAG GTAGTATTTT CACTTTCTAA AGGTTCTCAC
187951 ACACTGAATA TAAACTCTTA TATTATAACC TTCAATTCCA AACAAAGCAG
188001 CTTTTTCATG AAGCAATTCC AGACTTTCAT CTATCTTGAA AAGAATGTGA
188051 AATCAAGAAT CCTGAGAAGT CTAAAAATAG AAGGTATTAT TTCCAAGCAA
188101 GAAAGGATAA AGTTGAATAA TTACAGGCAT ACCTCGGACA CATTTCAGGT
188151 TCAGTTCCAG ACCACAGCAA TAAAGCAAAT ATCGCAGTAA TGCAAGTCAC
188201 ATGAATATTT TGATTTCCCA GTGAATATAA AAGTTATATT TACACTATTA
188251 TTGTCTATTA GGTTTACAAT AGCATTGTAT CTAAAAACAA TGTACATGCT
188301 TAATTTAAAA ACACCTTATT GCTAAAAAAT TGCTAACAAT CATCTGAGCC
188351 TTCAGCAAGT CATAATCATT TTGCTGGTGG AGAATCTTGA CTCGATATTG
188401 ATGGTTGCTG ACAGATTAGG GTGGCAGTTG CTGAAGGTTT TGGTACCTGT
188451 GTCAATTTCT TAAGATAACA CAACAATGAA GTTAGCCACT TCAGTTGACT
188501 CTTTCATGAA AGATGTCTCT GTAGCATGCT AGGTGTTTAA TATCATTTTA
188551 CCCAGAGTAG AACTTTCAAA ATTGGAGTCA GTCCTCTCAA ACCCTGCTGC
188601 TGCTTTATCA ACTAAGTTGA AATAATATTG TAAACATTTT GCTGTCATTT
188651 CAGCAATATT CACAGTGTCT TTACTGGAAT TAGATTCTGT CTCAAGAAAC
188701 CACTTTCTTT GCTCATCCAT GAAGGGCAAC TCCTGATGTT TTCAAGTTTT
188751 ATCATGACAT TGCAGCAATT CATTCATATC TTGTCTCTAC TTCTGCTTTT
188801 TCTCTTGCTA TATCCACAAC ATCTGCAGTT ATTTTCTGCA ACGTCATCCT
188851 TGAGGGTAGG TGTTAATTTC TTCAAAACTC CTGTGATTGT TGATTTTTTT
188901 TACCTCCTCC CATGAATCAC AGATGTTCTT AATGGTATCT AGAGTGTTGA
188951 GTTCTTGGCA GAGTATTTTC AGTTTACTTT GCCGGATCCA TTGGAGGAAT
189001 CACTATGGCA GCTATAGCCT TAGAAAATAT ATTTCTTAAG CCATAAGACT
189051 TGAAAGTTGA CATTTCTCTG TGATTGATGG ACTGCAGAAT GGATGTTGTG
189101 CTAGCAGATA TGAAAGCAAC ATTACTCTTC CTGTGTATCT CCATCAGAGC
189151 TTTTAGGTGA CCAGGTGCAT CATCAGTGAT CAGTACTATT TTGAAAGCAA
189201 TCTTATTTTC TGAGCAGTAG GTCTCAACAG CAGGCTTAAA ATTCTCCATA
189251 AACCATGCTG TGAACAGATG TACTGTCATC AACCTTTGTT GTTCCATTTA
189301 TAGAGCATGG GCAGAGTAGA TTTATCATAA TTCTTACTAG GTTTAGGATT
189351 TTCAGAATGT AAATGGGCAT TGACTTCCAC TTAAACTCAC AAGCTGCATT
189401 AGGTCCTAAC AAGAGATCCA GCCTGTCCTT TGAAGCTTTG ATGCCAGGCA
189451 ATGACTTCTC CTTTCTAGTT ACAAAAGGAT TGTTACATCT ACATTGAAAC
189501 CCTAAATGTG GCCACCTTCC TCAATGATTT TAGCTAGGTC TTCTGGATAA
189551 CTTACTGCAG CTTCTACATC ATCAGCACCT GCTGCTTTAC CTTGCATTAT
189601 TGTCTTATAG AGATGGCTTT TGTCCTTAAA CCTTGTGAAC CAACTGCTGT
189651 TGGCTTCCAA TTTTTATTTT GCAGCTTCCT CCCCTCACTC AGCCTTCATG
189701 GAATTTTTAA TTCCATGTTA GGGTCTTATT CTGGATTAGG CTGTGGCTTA
189751 AGGGAATGTT ATGGCTGCTT TGACCTTCTG TCCAGATCAC TAAAACTCCT
189801 TCTCAACAAT AAGGCTGCTT TGCTTTGTTA TTCATGTGTT CACTGGAGTA
189851 GTACTTTTTA TTCCTTGAAT AACTTGTTAT TTGCAATCAC AACTTGGCTA
189901 ACTCTGGGGC AAGAAGCTTA GTTTTCACCT ATCTCAGCTT TCAAGGCCTT
189951 CCTCACTAAG TTTAATCATT TGTAGCTTTT GATTTTAAGT AAGAGAAGTG
190001 TATCTCTTCT TTTCACTTGA CCATTTAGAG GTCATTGTAG GGTTATTGGC
190051 TTAATTTCAA TATTGCCGTG TCTCAGAGAC CCAAGGAGAC AGAGAGAGAA
190101 GGGAGAATGG CCAGTGAGTG GAGCAGCTGG AACACACCAT ATTTATTTAT
190151 TAAGTTTTCT GGCTTATGTG AGTATGGTTT ATGGTACACC CCCAAAATAG
190201 GGTAGGGACA TTGAAAATCA CCAATCATAC AAAAGTAACA TAAAAAATCA
190251 TTGATAATAT CTGTTATGGT GACCTATGAT ATAGGATCTA CATTACATGT
190301 AATAAGGATG TAAAAGTTTG AAATATTGCT GGAATTACCA AAATTACCAA
190351 AATGTGATAT GGAGACATAA AATGAGCACA CACTTTTGGA AAAATGGCAC

FIGURE 3DDD

190401 CAATAGCCTT GCTTGATGCA AGGTTGCCAC AAACCTTCTA TGTTTAGAAA
190451 ATGCAATATC TGCAAATTGC AATAAAGTTC AGTAAAGCAA GACATGCTTG
190501 TACATTATAG TTTGTTCTTT GTCATGATTT ATAAAATAGG TTAAAGGGCA
190551 AACCTACTTG AAATTATAAT TTTAGCAAAT TATTTTACAC ATATTTAATA
190601 CCAAGTTTAG TCCATATTTT ATTCTGTTAA CTTTAAGACT ATATTGAAGT
190651 CATATTCCTG TAGGGCTATA GGGCTGTCCT TAATTTAAAA AGTCAAATTT
190701 ATGTAAATAA ATTTACACAC ATTTCTATGG GAGCATAAAT TTATTCACTA
190751 TCTCTGTACT CTTTCCAGAC ATGACTTACC ATGTTACCCA TGTCACCCAC
190801 TGAAATGGCT CCTTTTCATG TGAATTCTGC CTAGAATTTT AGTTCTACCT
190851 TTTAAACAAG TGAAATTAAT ATGTATATAT ATGCAATAGT TGGAAACATC
190901 AATATATAGT AACAGTTTTT GTACCTTTCA TTTTGTCTAT CATTATCTCC
190951 TTTCTTTTGG GTTCAAAAGT ATGTCTTTTG GTAGTTCTTT TGATAAAGTT
191001 CTATGAGCAG TTAAGATTTT TATTTAATGG ATATTTAAGA ATAGCTTTAT
191051 TTTTTCTCTC CCTCTTCAAT GATTGTTTAT TTAGATGTAG AATACAAGAT
191101 GATGATGATT TTTCTTCAAC ATTCTGAAAA TGTTATTTCC CCGTCTATGA
191151 GAATCTATTA TTGCTAATGA TCTGCCGACA ATTTAATTGT CATTTCTTGG
191201 GAGATTATGT ATAGGTTCTG TATTTTTGGT TTTTAGTTAT ATCTGATGTG
191251 TCTGGGTGTG GATTTATTTT TTTCCTGCTT TTCATTCTGT GTTTTTAACC
191301 TGAGAAAGAG AGAGACAGAG AAAGAGAGAG AGAGAAAGAT TGCTTTCTTT
191351 TATTCTGTAT TTCTAGAATT TTTATTAAAT ATGTTTGTTG GAAACTTTCA
191401 ATTTATCCTG TCTTTGAAAT AATTTAAATC TCAGCAATAA TTTCCAGGTT
191451 TAGAATTTTC ACTTTGACTA TGCCTAGTTA AGAGTTTACC TCATCTGTTG
191501 AGATATCTTT ATCTTCACTA GTTTTAGTTG TTAACTTTTT CGTTCTTACT
191551 TTTTGTTTCA TTTCTGCCTA CTTTGTTACA TAATTCTCTT CCTCTTTTAT
191601 GGTTATTTTA TTCTGGATAT ATTTTAAGGT CCCATTCTAA TTGATTTGGA
191651 TCAAATTAAT CTGATTATTT AGTGTGTTGC CTACATTTCT AAGCATTTGG
191701 GTCTATCATG TACTTTGGAA TTGTAGTAGG CTGACTTTCT GGAAATTTCA
191751 TATTTTCCTG TCTGATTTCT GTTACTGTGT CATCAGTTTT TTTATTTGAA
191801 AAGTTTGTGA TTATACCAAC CCAGTTCCCT AGGCTTTAAA TAGAGAAAAT
191851 TTAAGGGGCC TAATAAATTT CCCAAAGAAT TCAAGTTAGT AATCCTGGTT
191901 GACAGGTAGT TCTGCTTCAT GCAGTAATTC AGGGATCCAG ACTTCTTGCC
191951 TTTAGTAAAG CAGACATCTC TTAAAGCCTT GTAGTTGTCT GTATCCAGCT
192001 CAGAGATTAG AGCAGACTTA TGTCCTTCTT AGTCAACTCA TATTTGAAGA
192051 GTCACATATC ATCTCCTATC ACATACCAAC AATGACTACA GTATATGGCT
192101 ACACATAACA CAAATAGAGG GAGTTGCTAT TAAATGTTGT TCTTAGCTCA
192151 GTAGTCACTT TCCACAAACA ATTCTCTGCC ATGGAAGAGG AAGACCAAAT
192201 TTTTCTAGAC ATTTGGTCAT CTCTGCAACA GTCTGTCACT TCACCAACAA
192251 AATATAGATA TTGATCCTCA TGTGTCTGAT AATGCACAGT TTTCTCCATC
192301 AGGCTCAAAT AATCCCTGAA CCCCTAAGAT GAATAAGCAT AACACAGGCT
192351 GTCAGAGCTG ATTAGCCACC AGTAACTACA TCAGAAATGG TCATGGATGA
192401 CAGAAGAATC TCACAGATAG TGGAGTTGAA GGTCATTGAG AACAATGACA
192451 CACACCATTT AATCAGTGTC CATATCTTTT GGAGAGCTTC ATATTACCTA
192501 CCCAAAAAGA TTTTCCTATT TCTTTTCCTT CCAGCTCTCA ACCCAGCTAA
192551 TTATTGACTG AACCCATCTG TTCCTGGAAA TATTAGTATA TTGTTAAATG
192601 TGTCAAGTAG CAACCAAGAC AAAGAAATCA TAGCTGTTGG CCGGCCTTCC
192651 AAGTTATTGC ATATTAAAAA GTTATACCAA GGCTATTACT GTTGTGTAAT
192701 ATAGATTTTC ATCTATCCAA AGCCTCCTGT TACACATCAC CTGTCCCCTG
192751 ATTGCTAAGT TAATGTCACT TATTTTAGAG TTTTGTTATG GGTCTATTCC
192801 AATTACCATG TGTGTATGTA TAAACACACA CACACACACA CACACACACA
192851 CACATATATA TAGCCATATA TAGCCACTCA TATATAGCCA TATATATGTA
192901 TACACACACG TGTGCTTTTT TTATATATTT TATATATATA TATGTATATG
192951 TTGGAGTTAA AATATTGTTT AAAAGCTGAG GTAACAGACA AAAATTTCAA
193001 AGTCCAGAGC CTTACAATGT AGAAGTTAGT TTTTCATTCA CGTTACAGTC
193051 TAAGGTTTGC TTGTTGTTGA GGGCTTTCCA TCATACACAA AATAAGGGAA
193101 CTGTGCATTT TCTTTCTCTA GCTCTGTTAT CACCTGTGGA TTTGTTGTTA
193151 TCTGTATCCA ATGAGTAGAG CATATATGTA TCCAAGAAAG AGAGCATATA
193201 TAGTATACAA GTGCCTCTTA AAAAACTTGC CATAGAAATG ACATGTATGT
193251 AATCAACAAG GTAAAGGTTT TTAGTGTAAG GTTAAATATT GTCATGTCAA
193301 GTAATTACGG TAATCAGGAT TTTTCTTTTT TGAACAGTAG GCAGGTAGTA
193351 AGCTAAGTTA TATATATATA TATAGTGTAT ATATCTTAGC AATGTAAATT
193401 AAATTTGGGG CCTGATTTTT AGATTTTTAG CTGTGTCTTA TCTGGCTACA
193451 AAAGGCAAGA CATTTCTTTA CAGCCTTCCT AAATCTGTGG TTCTCTGAGG
193501 ATATTTTGAT CTGAAAGATT AAAGCCCAAA GCTTCTTACT TTTTTTTTCT
193551 GTAAACTCTC CAGCCCAGTC AGAAATTGAT ATATATATAT ATGCATGTGT
193601 GTTCGTATAT ATGTGTGTGT GTGTTTCATA AAACCAGATA TAAACCGAAC
193651 TAAGTATGCC AAATTAAAGT TATTTTTATA AATTCAAACC TTATTCTCTT
193701 TATATAGAAA TAAATAGTAT TCAACTATTT TGAAGAAAAT GTGATTATTT
193751 TCATATAGAA ACTAAAAATA GCAACAGGGA ACATTTGTGG TAAACCTTCT

FIGURE 3EEE

193801 GCAATAACAG TTCATGCATT ATTTGAAGAA TAATGTATTT TACATAAATA
193851 CATTCAAATT GTTTTTAAGA TATCTTGTTG TCTCTTGTAA GAAAATCATC
193901 CCAGATGTGG ACATAAACTC GGATATAACT TATGGTGATA TTGGAGGACA
193951 TTCGTAATAT TTTTGAGTCC TTTGAGACAA TAGCTTTACA AAAATTTAAG
194001 AAATTACTGG TGTTCTCAGT TATTCATGTG GCCTTTTTAG GAAATAATAC
194051 TTTTTGTACT CAGTTTTTTC CTTCCTTTGG CATGTGATAC TATCAATTGA
194101 AAATTTGACT TTTATAAATA GTTCTCCATT ATGATATTAT GAAAACTTCT
194151 GGTAAGTTAT CGTTTTCAAT CTGAAATTAC TACAAACTAT TTTTTTAGAA
194201 TGAGTATCAA TAAATAAATC AATATTATTA CTGGAAATGG TAGTCTCAGT
194251 TTTACAGGGA ACTGTAGAGT AGTGGTAAAT TTAAAGAGAT GGAGATGTTC
194301 AGTTTCAAGT CACTGTATAC AAGGACTATC AGCATGAAAA GAAGCATGCT
194351 GTACCAAAAA TAGATGGGAA CATTGAGACC GTAAAAACAA GCTCTGCTTT
194401 TCTGCAGCAA TGGACAGAAA AAAGCATGAT TTATTCCCAT TATTGGACAG
194451 TATCAAAAGT GACTGCCATA AAAAGTGATG AAAACCTCTT GAAAGATGGA
194501 AACACTGTTC TGTGGACAGA GATAACTATT GTCTTGGATA GAATTCTTTA
194551 ACTAGGATTA TGGTATATTT GGTCTTTTTT AAAATAAATG ACTAATATTC
194601 TCATTTCTTG GTTTTATTTC TATTCTTTTT TAAAAGTAAA CTACTCTTCA
194651 GGATTGGTTA TTTTTTACCG CCTCGTAATT AAGGAGCCTA TATTCTTTAT
194701 GTTTACAATT AAATATTTTT AATAAAATTA AATGTAAAAA TTGTGTTAAT
194751 TGAAGATTCT CTATTAATTT AATAATTGCA TTATGACCAG GAGGACTTTC
194801 CTCTTGAAGC CTAATTTTAT GTGGGTGCAT TTATATATAG ATTGCTATTA
194851 TGAACTAATT CACTATGGAG ATGAAGTATT AATATTATAT GTATATAATT
194901 TTTTAAATTA GCCTATAAAA TAAATAGCAT ACCTTACTTA TGTAAATAAT
194951 TTTTATTCAT GAGGGTTGTT TTTTTTTTCA GAAATTCTCT TTCATCTATT
195001 GAGGTGACCA TAAAATTTTT CTATTTATCT ATCATGAGAT ATGTTATAAT
195051 AATATATTTC CTTAGATGAC CAATCTGTGG TTTAATGAAG TTAAGTTATT
195101 TGACCTTGAT GGATTGTTAC CTTAATGTTG AATATTATGT ATTTTCTTTA
195151 ATTTATTAAA AACTGGGATG AGGAGATTCT GTTGAATGCT ATGAAGTATA
195201 AATATGTTTT GAGTGACATA AAGAATATAA TATATATACT ATGTTCTTGG
195251 ATAGGAGTTG TAAAGAAGTC AGACTCAAAA TTCTTACTGT TTTTGCTACT
195301 TTGAATTCAG CAAAAACGGT GCTCATTTTT GTATAAAATA ACAAATGCAT
195351 TGCAATATAA AGGAATATTT AAAAAGAACA GTAAACTAGA AGAGTATTCC
195401 TGGCAGATAT TAAAATGTGT TTAAAGGACT ATATTTAAAA TATATAGTAT
195451 TAACTTCCAA AGATAAATAT TCATCAATGT TACCAAGAAA AGAGTTTAAA
195501 AATAGACTAA ATTACATGAA GTAGTAAAAC AATGGTGAAA TTGACTTTAT
195551 TAATTAATGG GAAGAATAGA CAGATTGTTT AATGCCATGG TTGTTATGTT
195601 GTAGGGGTTG ATATTGGGGA GGAGAAACAA TGATCATTTG GACATAGGGT
195651 GAGTATTGCA ATTTCTTTTC TTTTTTTTCT TTTGAGACAG AGTTTCACTC
195701 TTGTCGCCCA GGCTGGAGTG CAATGGTGAA ATCTCAGTTC ACTGCAACCT
195751 CTGCCTCCTG GGTTCAAGAG ATTCTGCTGC CTCATCCACC CAAGTAGCTG
195801 GGATTACAGG CGCACACCAC CATGCCCAGC TAATTTTTGT ATTTTTAGTA
195851 GAGATGGGGT TTTGCCATAT TGGCCAGGCT GGTCTCGAAC TCCTGACCTC
195901 AGGTGATCCT CCCACCTTGG CCTCCCAAAG TGCTGGGATT ATAGGCCAAT
195951 TTCTTAACTA AGCCCCAGAA GAGTCACTCT CACAATTAAA TGTGAGTTGA
196001 ATGTTGGAAA TTAGCAGCCA TCGTACCTTA GTGGAGAGAT CTATTTGGGG
196051 AAAAGAGAAT TCCCACAGAG TTTCTTGTTG CTTTAAAATG AAGCCTAAGG
196101 CAAAGTTATA ATAAAATGAG GCTGACTTGT AGGATACAAA TTAGGATTTT
196151 CATGAAAATT TATAACTGTA GTGAAGCAAT AACTTTTTAA AAATGATTTG
196201 CTTTCCTATT TCTTTTTTTC TTTATTTCTT CTTCAAAAAG AAAAGGGGGG
196251 ATAAATGTGC AGAACACGCA GATTTGTTAC ATAGGTATAT TTGTGCCATG
196301 GTGGTTTGCT GCCCCTATTG ACCCGTCCTC TAAATTCCTT CCCCTCACCC
196351 CCCCACCCCA CAACAGGCCC NCAGTGTGTG ATGTTCCCCT CCCTGTGTCC
196401 ACGTGTTCTT AATGGATGTT CAACCCCCAC TTATGAGTGA GAACATGCAG
196451 TGTTTGGTTT TCTGTTCCTG TGTTAGTTTG CTGAGGATGA GGGCTTCCAG
196501 CTTCATTGGT GTCCCTGCAA AGGACATGGT CTCATTCCTT TTTATGGCTG
196551 CATAGTATTC CATGGTGTAT ATAGATACCA CGTTTCTGTT ATCCAGTCTA
196601 ACATTGATGG GCATTTGGTT TGGTTCCATG TCTTTGCTAT TGTAAATAGT
196651 GCTGCAATAA ACATATGCAT GCATGTGTCT TTACAGTAGA ATGATTCATA
196701 TTCCCGTGGT TATATACCCA GTAATGGCAT TACTGAGTCA AATGGTATTT
196751 CTGGTTCTAG ATCCTTGAGG AATCACTATA TGTCTTCCAT AATGGTTGAA
196801 CTAATTTACA TTCACACCAA CGATGTAAAA GCATTCCTAT TTCTCCACAG
196851 CCTCACCAGC AACTATTGTT TCTTGACTTT TTAATAATCA CCATTCTGAC
196901 TGGCATGATA AGGTGTCTTA TTGTGGTTTT GATGTACATT TCTCTGATAA
196951 TCAATGCTGT TGAGCTTTTT TTCATATTTT TATTGACCAC ATACATTTCT
197001 TCTTTTGAGA AGTGTCTATG TCCTATGCCC ACTTTTTGAT GGGGTTGTTT
197051 GTCTTTTTCT TGTAAATATG TTTAAGTTCC TTTTAAAGTC TGGATATTAG
197101 ACATTTGTCA GATGAGTAAA CTGCCAAAAT TTTCTCCCAT TCTGTAGGTT
197151 TCCCATTCAC TCTGATGATA GTTAATTTTG CTGTTCAGAA GCTCTTTAGA

FIGURE 3FFF

197201 CTAATTAGAT CCCATTTATC AATTATGGCT TTTGTTGCAG TTGCTTTTGG
197251 CATTTTTGTC ATGAAGTCTT TGCCCATGCC TATGTCCTGA ATGGTATTGC
197301 CTAGGTTTTC TTATAGGGTT TTTATGGTTT TTGGTTTTAC ATTTAAGTAT
197351 TTAATCTATC TTGAGTTAAT TTTTGTATAA GCTATAAGGA AAGTGTCCAG
197401 TTTTTCCAGC ACCATTTAAT GAATAGGAGA TCCTTTCCCC ATTGCTTGTT
197451 TTTGTCAGGT TTGTCAAGGA TCAGATGGTT GTAGATGTGT GGTGTTATTT
197501 CTGAGGTCTC TGTTCTGATC CTTTGGTCTA TATGTCTGTT TTGGCATCAG
197551 TACCATGCGG TTTTGGTTAC TGTAGTCTTG TAGTACAGTT TGATATCAGG
197601 TAGTGTGATG CCTCCAGCTT TGTTCTTTTT GCTTAGGATT GTCTTGGCTA
197651 TGCCAGATCT TCTTTGATTC CATATGAAAT TTAAAATAGC TTTTTTTTCT
197701 AATTTTGTGA AGAATGTCAA TGGTAGTCTG ATGGGAATAG CATTGAATCT
197751 ATAAATTACT TTGAGCAGTA TGGCCATTTT CACATTATTG AATCTTCGTA
197801 TCCATGAGGA TGGAATGTTT TCCCATTTGT TTATGTTCTC TCTTATTTCC
197851 TTGAGCAGTG GTTTGTAGTT CTCCTTGAAG AGGTCCTTCA TATCCCTTGT
197901 TAGCTGTATT CCTAGGTATA TTATTCTCTT TGTAGCAATT GTGAATGGGA
197951 GTTCATTCAT GATTTGACTC TCCGCTTGCC TATTGTTGAT GTAAAGGAAT
198001 GCTTGTGAGT TTTGCACATT GATTTTATAT TCTGCGACTT TGCTGGAGTT
198051 GCTTATCAGT TCAAGAGGTT TTTGGGCTGA AATGATGGAG TTTTCTAAAT
198101 ATAAAATCAT GTCGTCTACA AACAGAGACA GCTTGACTTC CTCCCTTCCT
198151 ATTTGAATAC CCTTTGTTTC TTTCCCTTAC CTGATTGCCC TGGCCAGAAC
198201 TTCCAATACT ATGTTGAATA GGCGTGGTAA GAGAGGGCAT CCTTGTCTTG
198251 TGCCAGTTTT CAAAGGGAAT GCTTCCAGCT TTTGCCCATT CAATATGATA
198301 ATGGCTATGA GTTTGTCATA AATAGCTCTT ATTATTTTGA GATGTGTGCC
198351 ATCAATACCT AGTTTATTAA GAGTTTTTAA CATGAAGGGA TATTGAATTT
198401 TACCAAAGGC CTTTTCTGCA TCTATTGAGA TAATCATGTG ATTTTTGTCT
198451 TTGGTTCTAT TTATGTGATA GATTACATTT ATCGATTTGG GTATGTTGAA
198501 CCAGCCTTGC ATCCCAGGGA TGAAGCTGAT TTGATCATGA TGGATGAGTT
198551 TGTTGATGTG CTGCTGGATT CGGTTTGCCA GTATTTTATT GAGGATTTTT
198601 GCATCAATGT TCATCAGGGA TATTGGCCTG AAGTTTTCTC TTTTTGTTGT
198651 GTCTCTTCCC AGTTTTGGTA TCAGGATGAT GTTGGCTTCA TAAAATGAGT
198701 TATGGAGGAG TTCCTCCTTT TCAATTGTTT GGAATAATTT CAGAAGGAAT
198751 GGTCCCAGCT CCTCTTTGTA TTTCTGGTAG AGTTCAGCTG TGAATCCATC
198801 TAGTCCTGGG CTTTTTTTGG TTGGTAGGCT ATTAATTACT GCCTCAATTT
198851 AAGAGCTTGT TATTAGTCTA TTCAGGGATT CAACTTCTTC CTGGTAGGGT
198901 GTATGCGTCC AGGAAGTTAT CCATTTCTAC TAGATTTTCT AGTTTATTTG
198951 CATAGAGATG TTTATAGTAT TCTCCAATGG TGGTTTGTAT TTCTGTGGGG
199001 TCAGTGGTGA TATCCCCTGT ATCATTTTTT ATTGTGTCCA TTTGATTCTT
199051 CTCTGTCTTC TTCTTTGCTA GTCTGGCTAG CAGTCTATTT TTTTTTTAAT
199101 TTTTTCAAAA AAACAGCTCC TGGATTCGTT GATTTTTTGG AATGTTGTTC
199151 TTGTCTCTAT CTCTTTCAGT TCTTCTCTGG TCTTAGTTAT TTCTTGTCTT
199201 CTGTTAGCCT TTGGATTAAT TTGCTCTTGC CTCTCTAGCT CTTTTAATTT
199251 TGATTTTAGG GTGTTGATTC AAGATCTTTC TAGCTTTCTG ATGTGGGCAT
199301 TTAGTGCTAT AAATTTCCCT CTTAACACTG CTTTAGCTGT GTCCCAGAGA
199351 TTCTGGTATG TCATCTCTTT GTTCTCATTG ATTTCAAAGA ACTTGATTTC
199401 TGCCTTAATT TCATCATTTA CCCAGGAGTC ATTCAGGAGC AGGTTGTTCA
199451 ATTTCCATTA AATTGTGTGG TTTTGAGTGG GTTTCTTAAT CCTGAGTTCT
199501 AATTTGATTG CACTGTGTTT GGAGAGACTG TTTGTTATTA TTTCAGTTCT
199551 TTTGCTTTTG CTGAGGAGTG TTTTACTTCC AATTATGTGG TCGATTTTAG
199601 AATAAGTGCC ATGTGGCACT GAGAAGAATA TATATTCTGT TGTTTTGGGG
199651 TGGAGAGTTC TGTAGACGTC TATTAGGTCC ACTTGATCCA GAGCTGAGTT
199701 CAAGTCCTAA ATATCCTTGT TAATTTTCTG TCTTGTTCAT CTGTCTAGTA
199751 CTGAGAGTGG GGTATTAAAG TTTTCCACTG TTATTGCATG GGAGTCTAGG
199801 TGTCTTTGTA GGTGTCTAAG AACTTGTCTT ATGAATCTGT GCCCTCCTGT
199851 ATTGGTTGCA TATATATTCA GAATAGTTAG CTCTTCTTGT TGAATTATTG
199901 CCTTTACCAT TATGTGATGC CCTTCCTTGT CTTTTTTGAT CTCTGTTGGT
199951 TTAAAGTCTG TTTTATCAGA GATTAGGATT GCGGTCCCTG CTTTTTTTTT
200001 TTTCTTTCCA TTTGCTTGGT AAATTTTCCT CCATCCCTTT ATTTTGAGCC
200051 TGTGTGTGTC TTTGCACACA AGATGGGTCT CCTGAATACA GAACACCGAT
200101 GGGTCTTGAC TCCTTATCCA AATCACCAGT CTGTATCTTT TAATTGGGGC
200151 ATTTAGCCCA TTTACATTTA AGGTTAGTAT TATGTGTGAA TTTGATCCTG
200201 TCATCATGAT GCTATTTGGT TATTTTGCAT ACTAGTTGAT GTAGTTTCTT
200251 CACAGTGTCT TTGGTCTTTA TATTTTGGTA TGTTTTTGCA GTGGCAGGTA
200301 CCAGTTTTTC CTTTCCATAT TTAGTGCTTC TTTCAGGAGC TCTTGCAGGG
200351 CAGACCTGGT GGTAATGAAA TCCCTGAGCA TTTGTTTGTC TGTAAAGGAT
200401 TTTATTTCTC CTTTGCTTAA GAAACTTAGT TTGGCTGGAT ATTAAATTCC
200451 TCGTTGAAAA TTCTTTTCTT TAAGAATGTT GAATATTGGC CTCCCACTCT
200501 CTTCTTGCTT GTAGGGTTTC TGCTGAGAAG TCTGCTGTTA GTCTGATGGG
200551 CTTCCCTTTG TAGGTAACCT GGCCTTTCTC CCTGGCTGCC CTTAACAGTT

FIGURE 3GGG

200601 TTTTCTTCAT TTCGACCTTG GAGAATCTGA TGATTATGTG TCTTGCAGAT
200651 TATGTTCTTG TGGAGTATCT TAATGGTGTT CTCTATACTT TCTGAATTTG
200701 CATGTTGGTC TGTCTTGCTA GGTTGAGGAA GTCCTCCTGG ATAATATCCT
200751 GAAGTGTGTT TTCCAGCTCA TTTCCATTCT CCCTGTCTCC TTCTGGTACT
200801 CCAATCAATC ATAGGTTCGG TCTTTTTATG AAGTCACATG TTTTTTGGAG
200851 GCTTTGTTCA TTATTTTTCA TTCTTTTTTC TCTATTCTTG TCTGCATGTC
200901 TTATTTCAGT AAGGTGGTCT TCAAACTCTG ATAACCTTTC TTCCGCTGGG
200951 TCGATTTGGC TGTTGATACT TGTGTATGCT TCATGAAGTT CTTGTGCTGT
201001 GTTTTTCAGC CCCATCAGGT TGTTTTATGT TCAAGCTATA TAAACTGGTT
201051 ATTGTAGTTA GCAGTTCCTC TAACCTTTTA TCAAGGTTCT TCACTTTTTG
201101 AGTTGGGTTA GAACATGCTC TTTTAGCTCA TCATAGTTTT TTATTACCCA
201151 TCTCCTAAAG CCCTACTTCT GTCAATTTAT CCATCTTATC CTCCATCTAG
201201 TTCTGTGCCC TTGATGGAGA GATGCTGTAA TCATTTGGTT GAGAAGCAGG
201251 CACTCTGGCC TTTTGGGTTT TCAGCATTTT TTCATTGATT CTCATCTATG
201301 TGAATTTGTG TAGTTTCGGC CTTTGAGGCT GCTGACCCTT GGATGGGTTT
201351 TTTATGGGGG CCCTTTTGTT GTTGTTGTTG ATGATGATGA TGCTGTTGTT
201401 GTCCCTTTCT GCTTGTTTGG TTTTCTTTCA ATAGTCAGGT CCCTCTTCTG
201451 TAGGGCTACT GCAGTTTGTT GGGGGTTTAC TTCATGCCTT ATTCATCTGA
201501 TTCGCCCCCC TGCCTGGAGA TACCATTCAT GGAGGCTGGA GAGCAGCAAA
201551 GATGGGTGCC TTCTCCTTCT TTTGGCACCT CTGACCTTGA AGGTCACCAA
201601 CCTGATATCA GTAGGATCAC TCCTGTATAG GGTGTCTGAC AACCCAGTTG
201651 AGTGTCACGG GGAGCAGGAC TCATTTAGTG AAGCACTTTG TCCCTTGGTG
201701 GAGAAGGTGT GTTATTGCTG GAGGGAAACC CACTAGTACT GGGCTGCCTG
201751 GATTCCTCAG AACTACCAAG AGGAAAGGCT AAGTCTGCTG CTCTACAGAG
201801 ACCGTTGGCC ACTCCTTCCC CTAGGGGCTA AGGCCCAGGG AGATCCAAAT
201851 TCTGTCCCTG ATCCTCTGGC TGGAGTTACT GGAGATCCTG CAGGGAAGTC
201901 CTGCCCACTG AGGAAGGATG GGTCCGGGTT AGACCTTAAG AGGCATTCTG
201951 GCTGCATACT GCCACAGCCA GTATTTTGGG CTGTGGGGAC AAGTCTTGGG
202001 ACCAAACCAT CCAGCCTCCC TGGCTCTGGC AGGGGAAAAG AGCAGCCTAG
202051 AGCTATAGAA ATGGGTGCTG CCCTTCCCCC ATCCAGGGAG CTTAGTGTGG
202101 TAGGCAGTTG CCAGTCCCAC TGCTGGTTGC TTCCTCTCTG CCAAAGAGCT
202151 CAAAGGGCTT AGACAGCAGG CAGCTGCGCT GGTGCTGGTT GCCCCTCCCC
202201 CAAGGAGTTT CGTTGGCTTA AGCAGATTCC AGCTGAGAGG CTGTAAGAAT
202251 CTGCACATTC CAGGGTTGGG AAGCTACGCC CCGGTGTCAT GGTTTCATGA
202301 GTGGGATCTT TCGATCCATG GGTTGCACAG TTCCACAGAA AAAGCAGTTT
202351 CCCTGGCTGG GTAGCATGCT CACTCACCAC CTCACTTGGC TGGAGGGAAC
202401 AGACTCCCCT TCCCTTGTGG CTCTCAGGTA GGCCACCACA CCACTCTGCT
202451 CTTCCTTCTC TCCATGGGTC ATGCTAGCCT TCTAGTCAAT TTTGATGAGA
202501 GAACCTGGTT ACCTTGGTTG CCGTTGAAGG ATTCACATGC TTATCATTGT
202551 TTTTTTTTTT TTGATAGGAG CCTCCAAAGG CCGCTGCTTC TAGTTGGCCA
202601 TCTTGGCCCC ACCCCGAAAC AGTAACCTTT GAAGAATAAA AGAAAAAGCA
202651 AAAGAGTAGC ATTACTAAAA TATTAAACGG TTACATTTAC AGCCAAAATT
202701 TGTTTTGTTT TTATTTTGGT GGGTTTTCAT TAAGAAGACA TTGTGTTGGT
202751 ATGAAATATG GGTTCTGGTC AATCAAAGGG AAATTCTAGA TTATTTGTAA
202801 TATCATGTAA TAACTTGTAG CAGAAATTGG CAGACCATAG CCTGATTGCC
202851 AACCCCAACC CATTTTTATA AATAAAGTGT TTTGGAATAC AGCCAAAGTT
202901 ATTCATTTAC ATATTATCTG TGTCTGCTTT CAAGCTATAG TAGTAGGGTT
202951 GAGTAGCTGT GTCAGACACC ATATGGCCTA CAAAGCTTAA AATATTTACT
203001 ATCTAGTCAT TTATGGGTAA TATTTGCATA CCTCTGCCCT ATAAGCAAAT
203051 TAATGCATAT CTTGGAAATA TAAAGTTATC AAACTTGTTA TTTTTTAGCC
203101 ATATATTAGT GGGTAGCATT TTTGTAATTA AACATAGAAT AAAACCTCTA
203151 CTGGAAATAT TTCCCTCAAA AGGTAACCAT CTTTTTATTC AGTCATTTAT
203201 CTTATTTAAA AAAATTATTT TTATTTATTT ATTTATTTAT TTTGAGGCAG
203251 TGTCTCACTC TGTTGCCCAG GCTGGAGTGC GGTAGCGATC TCGGCACACT
203301 GCAACCTCCA CCTCCCGGGT TCAAGTGATT CTTGTGCCTC AGCCTCCAAG
203351 TAGCTGGGAC TACAGGCACA TGCCACCATG CTCAGTTATT TATCAAAGCA
203401 TCTATGCTAA GGAATATACA TTCAAAAGCT TTCAATAGAG GATTTCATAT
203451 TTATTTGTCT TCGGAAAGAA TTTGGTTTTT ATTAAAATGC AGAAATATCT
203501 GAGAGAGATT GTTAGTAAAA AATGTAGGGA TGTGTATGTG GTGCGTGTGT
203551 GTGTGTGTAT TTTCATAAAG GAGTGTTAGT CAAGTGCTTG CTACTTACTT
203601 GTAACCAAAC TAAGGTTTGG ATGCATGCCA CCTGAAAAGA CAAACACATA
203651 AGAAGTAAGG TTTCATAGAA GGAAAGCAGC TTTATTCAAG TGGTGACACC
203701 TTGGGAGATG GCCAGACTCA AGTCTGAAAA ATCCATCTTA AATTCTCAGT
203751 CTGTATAAGG GGATTTTAAG GGGGAAGGTT GCATGGAAAC TGTACAGGAG
203801 TGTGCATGGT GCAGGTCTGC TTGTTGTTTT CCACTGCTAG TTTGAGTAAC
203851 AGACTATCCA GAGGCCTGGT TGGCATCATC TCAGTAGAGG TCAGGTTAGG
203901 GATTAACTGC ACAACTGTTT CATCTTGAAA GGAAGAAAAT TGAAACTGCC
203951 ATCTCCTGCC TCATGCCTGG ATTGTTGTAA GATTAGCCTT TGGACATTTC

FIGURE 3HHH

204001 AAGCAAACAG GTAGTTACAT ATATGTGTAT CAAGAAACAA ACAAGGGAGG
204051 GATTATCTTT AGAGTAAGCT AGCAAACTGG CTATACTGGT TACATTAGGA
204101 GACATTTCTC AAGGACTCTT TTTAATACCA GCTAATTCTC TCATTTTGCA
204151 TTTTGACCAA TTGCCATGAC AGACACTAAA AATGTATTTG TGATTTGTTT
204201 AACTTCTATT TCTTTTTCAA CTTTTATTTT AGATTTAAGG GATATGTTTA
204251 CATGCTGGTT TTGTGGGTAT ATTGTGTGAC ACTAAGGTTT CTGATACAAA
204301 TGATCCCATC ACCCAGGTAG TGAGCATAAT ACTCAATAGT TTTTCAACCC
204351 TTATCCCCCA CCCGGCTCCT TCCTCTAGTA GTTTTCAGTG TCCATTGTTG
204401 CCATCTTTAT ATACATGAGT ACCTAAGATT TAACTCCCAC TTATAAGTGA
204451 GGACATACTT ACTTATAAGT AAGTATGGTT TTCTGTTTGT GCATTAATTT
204501 ACTTGGGATA ATGGCTTGCT GCCTTATCCA TGTTGCAGCG AAGAACATTA
204551 TTTCTTTCTC TTTTTTGTGG CTGCATAGTA CTCCATGGTA CATATATACC
204601 ATATTTTCTT TATCTGCTAC ACAATTGGTG GGCACCTAGG TTGATTCAAT
204651 GTGTTTGATA TTGTAAATAA TGCTGTGATG AACTTACAAG TGCATGTCTT
204701 TTTGGTAGAG TGATTGATTT AAAAATATAT ATGTACCCAG TAATGGGATT
204751 GTTGGATCAA ATGGTAGTTT TGTTTTAAGT TCTTTGAGAA ACCTACAAAC
204801 TGCTTTCCAT GGTGGCTGAA CTAATTTACA TTCCCAAACA GTATATAAGT
204851 TTTCCCTTTT CTTTGCAGCC TCACCAGCAT CTGTTTTTGC TTTTTTTTTT
204901 GAGACAGGGT CTGACTCTGT CACCCAGGCT GGAGTGCATT GGCATGATCA
204951 CAGCTCACAG TAGCATTGAC ATCTCCGACT CTGGGCTCAG ATGATCCTCC
205001 CATCTCAGCC TCCATGGTAG CTGGAACTAC AAGTGTGTGC CACCTGCCCA
205051 ACTAATTATG TATATTCATA TATATATGTA TGTATATTCA TATATATTTT
205101 TATATATGAA TATATTATAA AACTAGAATA TATATACATA AAATTTATAT
205151 ATGTGTGTGT GTGTGTGTGT GTGTATATAT ATATATATGT ATTTTTTTTT
205201 TTTTTTAAAG AAACTGGGTT TTGTCTTGTT GCCCAGGCTT GTCTCAAACT
205251 CCTGGGCTTA AGCAATCTGC CCCCCTCGGC CTCTCAAGTA CTGGGATTAC
205301 AGGTATGAGC CACCACACTG GACTTACTAT TTTTTTGACT TTTTAATAAT
205351 AGCCCTTCTG ACTGATTTCA AATGGTATCT CGTTATTGTT TTTATTTACA
205401 TTTCTCTCAC GATTAGTGAT GTGGAACACT TTTCATATGT TTCTTGGCTA
205451 CTTGTCTTTT GAGAAGTATC TGTTAGTATA TTTGCCCACT TTACTGGGCT
205501 TGTTTATTTA TTTATTTACA CTTGTTGAAT TGTTTTAGTT CTTTACAGAT
205551 TCTGAATATT AGACCTTTTT CAGATGCATA GTTTGCAAAT ATACTCTCCC
205601 ATTCTGTAGG TTGTCTGTTT ACCCTGTTGA TAATTTCTTT TGCTGTGTAG
205651 AAGCTCTTTA ACTTAATTAG GCCTCACTTG TCAATTTTTG TTTTTGTTAC
205701 AATTGCTTTT GAGGACTTAG TCATAAATTC TTTCTCAAGT CCAGTATTCA
205751 GAATGGTATT TCTTAGATTT TCTTCTACGA TTGTTGTAGT GTGAGGTCTT
205801 ATATAAATGT GCTTGTTTAA AAAAGTGTGA GTTAATGATT TATATTCTTT
205851 GTGTAAAAGT ATACACAGCA TCAGATTATA AATAAAATTT AAATTATATT
205901 TTACTTAGAA ATGATAAAAA AAAAGATTTT CTGTGAACCA TAGACTAAAT
205951 TTCCAGTAGG TTCTCATGTT TTTCTCCCTA CATCTATATT ATATTCTGCT
206001 TTTAGCAATC CTAGATATAT GTTTATTAAG GTGTGATGGA GGCCTAATAT
206051 TTACTGTGTA CCCACTACGT CCTGAAAAAC CATGAATTGC CATTAATTAT
206101 CACAGTCTGT GTCAAACAAT ACATAAATCC CTTGGAACAC AGTACTATTT
206151 ATAATTGTGC TGTTGCTTAT ATGAAGGGAT GTACACTCAC ATGGAGGCCA
206201 TAAATGTATA TACACTTTGT ATACTTAGCT TATTATGTTA TGAAATATGT
206251 TTAAAATGGA TGTTCTTTGA AATTTTCCCA AAATTGATAA TCTTGAATAA
206301 AAACTTTTTA TGAAGATATT TCTAAAATAA GTAATATATC TTATCTGCTT
206351 AAGATATAAA CAAGAACCTT TGTTTTCAAC CAAAATAATA GTTATATTCA
206401 AATTATGAAG CATGTTTTTG CATAGGAGTT TTATGTTTTT GTTTTTGGCA
206451 TGGGTCTTCA GTAATGCCTC CTGCAAACTT ATCATTATTG TATATTGTCA
206501 TTATCTTATT TTTGTACTTC TCTTTCTCTC TGCCCTCTCC ACCACCCAAT
206551 CTGTCTTATT TTTGCCCTTT AAAGAACTGA ATTTATGCTG AATGGTGAAT
206601 ATTTTATCAT TATATTTATT TATATTTGAA CTTTCTTATA CTGTGTACTT
206651 GATTAAACTT TCCTGTAAAA TGTGACTATA TTTTCCCATT TTATACCTCT
206701 TGTCTTTTAA GATAGAGATA AACAGATAGA GAAAGAGATA AAAAGAGCGA
206751 TAGATAGGTC AATAGATATC CAACTCATTC ATTCTAATTC ATCAAAAGTA
206801 AGGATTTGGA AAAATTATTT ACCATTAAAT ATTAAAATGA TTTTTCAGAA
206851 TTTTACTTCC TTCCTTCCTT TCCGTCCTTT CTCCTGCCTT CCCTCCTTCC
206901 CTCCCTTCCT CCCTACCTCT CTCCCTCCCT CCCTTCCTTC ATTTCTCCCT
206951 TTTTCTTTCC TCTCTCCCTT CACCTCCTTC CTTCTTTCCC TCCCACCTTC
207001 CTTCTTCCTT TCCTTTCCTT TCCTTCTTTC CTTCCTTTCT GTTATGGCAT
207051 AAATATGCAA AACTTATTTG GAGGAAATGG AGAAAATTAT TGCTTAATAC
207101 ATCTCTTCTT CCATTAAAGT TCTTTCTGTA TATGTATACG TGGCATTCTT
207151 AGGAAAGGAC TGCGATGTTG AAACATAAAT TAGCAATGCT TGCAGAATTT
207201 AATGATCTGC CTGTGAATAC AAAATATATC ATATAATAAT TCTGTACCTA
207251 CTAATGAAAC ATTGAAGAGT CCAGCATTGC ACGTGGAATG TTTCTTTAAA
207301 TGAATATTAC TTCAAAGGGA TGATGATCAA AGTATTTAAG AATTCCTAAA
207351 GGATCAGAAA TTCTTTTTTG AGATAATTTT CCTTAACATA ACAATGCATG

FIGURE 3III

207401 TTTATTTGCT GTCTGATGGC CATGGAGTAG TGGTATGTTA TGAAAAAATG
207451 TCTTAAATTT GCTGTGACAG CCTCTTTTCC CAGAAGATTA GCATATCAAG
207501 GTTTGTCTTC TATATATATT TGTAAGCTAG ATAAAAGTGT TAATTCTAAT
207551 TGAAATGGTT CCTTTAGTAG ATTTAATGAA CCCTCCACCA ACAAGTAAAT
207601 TAAACTGAAA ATTATTGACA CAAGTTTTAT CATTGGAGAA GAAAATAATT
207651 ACCAAAATCA TTGTCTCCTC TTGATCAAAT TTAACTCCCT TGTCATAGAA
207701 AATTGTAAAT TGAAATTAGG AGTAAAGGCC TGTGTGAAAA AAGAAGTAAC
207751 ATTATACAAT AAAGTATTGT AGAAGAAAAT CTTACTAGTT GCTGAAACCT
207801 TATACTGTAA GAAAAAGCAA GGGAAATAGA TGTTCAATTG GTAAAATCAG
207851 TATAAAGTAA CAACTTAAAA TGATTTTGTC CAGCTCTGTC ATTAAGTAGG
207901 GCCTATAAGC AGTAGTGGAA CTTTACCCCA GAAACATAGG TGTGTGTTTT
207951 CTTTTCCAGA AAGATCCAGG AGTGTTTGGG TTATAGCCAG TTTCATTTCT
208001 TAATACAGGA AAATTATGAG GGTCTGTCTG GACTGTCTTT TCAATGTCAA
208051 ACTAAATATG CTTTTAGAAT AAAAGAATAA GTGTTGTAAG GGGAAAAACC
208101 CATTAAAACT ATTCCCATCT CCAATTTTAA TGTTAAAAAG AATATATATA
208151 CATGATTACT TAAAATAAAT TATGTTTGGG AAAGGCTCTG AGTTCACAGT
208201 GATAATCAAA AGGGACACAT TAAAATACAA ATATAACAGA GTGGAAGGGG
208251 ATCAGGAGAG GAGTGAACAC TGCTGGTGAG AACAGCACTG GAGAGCGTGA
208301 TTCCACATCC AGAAGACGCA GCTCCCCACA TATTTGACAA GGCTCCCAGA
208351 CTCTGAGAGC GTTATCAAGT TCATTGGGCT CACAGAAACA GATAATTTAT
208401 TTAAAAATTA GAAACAAAAA CTTCACTAAT AGCTGACGAT CTCTGGATAG
208451 TGACTTTTTT TAATTATGAG AAAACATTTA AGGAAAATCA GTGTTTTTAC
208501 ATCCATTTCA GAATTGCTTT GGCTATTTGT TTATTGTCTT TCCTTGTTTA
208551 CTTGCACTAT TTGGCTAACC TGCAGTTTGT TCATTCTTCC ATTCTTCATT
208601 CTTCCTGAAA AAAAAAAAAA AATCAACAGC TTCATTAATC TTAAAATATA
208651 AAAAGAAAAT CCCAAAGTGG TGAATGAAAC ATTGAAGATA TGTGTCTTAC
208701 CAAAGCAGCT TGCTGTAGGT ATGGGCTGCA TTTTTTGTTT GATACTTTGT
208751 ATATTCAGAT AGTTATTTAT ATAGAAGTTA AATTCCACAA GTTTCTGGTA
208801 ATGACTTTAA ACAATTAATG TATCTTCCAA CAATAAAATC AACACTTCTG
208851 AATTTGAATG AAAAAAATCT GAATTTTTGG CAATGATTCA AAGCTTTTTC
208901 TCTGAATTTC AAAAGTTTTG ACAGAATCTC CACTTTAAAT TCCCTCCCAC
208951 TCTGTTAAAT TTAACTATAA TAATGTGAAC ATTCCAATTT CAGAAAAAAA
209001 GTAAATTAAA TATAAAAAGT TCTAATAAGA AATAGTTATT TACATTATAA
209051 ATTATGTATT TACTTTAAAA TGCATACAAT TCAGTTAAAA TCAAGAGACC
209101 AAATGAGACT TATTTATAAT AGCTCTATTA AGTAATAATG ACATAAAATA
209151 AACTGTATTT TAAAGTGTGC AGTTTGGTAA GTTTTGACGT ATGTCTAGAG
209201 CCGTGAACCC ATCATCACAA CTAAGACAAT AAGCATATCT TTCATTCCCA
209251 AATTTTTCCT TACGCACCTA TGTAATTCCT CTCTCCTTTC CCTTAGTACA
209301 GCCAATAACT ATGGCTCTAT ACACTTGTCT CTTTATGTTG GTTAACGTGT
209351 TCTAGAATTA TCACAGGCAT CTGCAGTATC CACTCTTTTG CCTGCTCTTT
209401 AATTCAATAT GATTATTTTG CCATTTGTTC ATGTAACTGG ATGTATCAGT
209451 ACTCAGTATT AAAAGTTCAT TACTTTTAAT GCTGAGTAGT AGAGCATTGT
209501 TTGGATATAC CACTAGTTGT TTATCCATTC ATTTGCTGAT GGACATTTTG
209551 GTAGTATCTT GTTTGTGGCT GTTACAAACA AATTTGTTAA GAACATTTAT
209601 AGAGGGACAG AGCAAGATGG CCAAATAGAA GCCTCCAATC ATCCCACTAC
209651 CACAAGGACA CCAATTTAAC AACTATCTAC CCAAAATAAG CACCTTCATA
209701 AGAACCAAAA ATCAGGTGAG CATTCACAGT ACCTAGACTT AATTTCATAT
209751 TACTGAAAGA GGCACTGGAA GAGGGTAGGA TATAGTCCTG ACTTACTGAT
209801 GGCACACCTC TTCCATTCCC TGGAAGTGGC TGTGTGGCTC AGAGTGAGAA
209851 TCTGTGTGTC TGGGAGAGGG GCAGTGCAGC AACTGTGAGG CATTGCATTG
209901 AACTCAGTAG TCCTTTGTAA TAGCAGAAAG CAAAACCAGG CTGAACACAG
209951 CTGATGCCAA CCCTCAGAAG GAGTATTTAA ATCAGCCTCA GCTAGAAGGG
210001 AATTGTCCAT CCCGGCAGTC AAAAAATTGA GTTCTGGCAA GTCTCACCCG
210051 CACATGCTAA AGTGCTTGGG GGCCCCAAAT AAACGGGAAA GGCAGTCTAG
210101 GCCCCAATGA CTGAAACTTC TAGGTGAATC TAGGGCTGAA CTGGACTCAC
210151 AGCCAGTGGA CTTATGGGGC AAGTGACCTA CACAGACACC ATTTAGGGTA
210201 GTGAAGGAAA TGCTCATGCT GCTAGATGTA TTGGAGCTCC ATTGTACGTT
210251 ATTTGTTTCT TTTCTCTTGC TGCTTTTAGG ATCCTTTATC CTTGATCTTT
210301 GGGGGTTCAA TTGTTAAATG CCTTTAGGTG GTTGTCTTTG GGTTAAATCT
210351 GCTTGGTGTT CTATAACTTT ATTGTATTTG GATATGGACA TCTTTTTCTA
210401 GGTTGGGGAT GTTCTTTGTT GTTATCCCTT TGAATAAACT TTCTATGCCT
210451 ATCTTTTTCT CTACCTCTTC TTTAAGGCAA GTAACTCTTA GATTTATTCT
210501 TCTGAGGCTA TTTTCTAGAT CCTGTAGGCA TGCTTTACTG TTTCTTATTC
210551 TTTTTTTTTT TGTCTCCTCT ATGTATTTTC ACATAGCCTA CCTTCAACCT
210601 CACTAATCCT TCTTCTGCTT GATCAAACCT GCTATTGAAA GACTCTGATA
210651 CATTCTTCAT TTGTCCATCA CATTTTTCAG CTCCAGAATT TCTGCTTGAT
210701 TCTTTTAAAT TACTTCAATC TACTTGTTAA ATTTACCTGA TAGAATTCTG
210751 AATTTCTTCT CTTTTTCTGT CTCCCATTTA TTTTGGGGTC TTTATTTGCA

FIGURE 3JJJ

210801 TGCATTTTTA CCGCTTTATG TGTAGGGACC AGCCCCACAG GGTCGGTGGG
210851 TCTCTCCCCA TGTGCGGAGA CGAGAGAGTG TAGAAATAAA GACACAAGAC
210901 AAAGAGATAA AAGGAAAGAC AGCTGGGCCC GGGAGACCAC TACCACCAAG
210951 TCGCAGAGAC CAGTAGTGGC CCCAAATGCC AGGCTGCACT GATATTTATT
211001 GGATACAAGA CAAAGGGGCA GGATAAGGAG AGTGAGCCAT CTCCAATGAT
211051 AGGTAAGGCC ACGTGGGTCA CGTGTCCACT GGCCATAGGG CCCTTCCCTG
211101 CCTGGCAGCT GAGGCAGAGA GGGAGAGGAG ACAAAGAGAG AAACAACTTA
211151 CACCATTATT AGAGACTTTT AGTACTTTCA CTAATTTGCT ACTGCTATCT
211201 AGAAGACAGA GCCAGGTGTA CAGGATGGAA CATGAAGGCG GACTAGGAGC
211251 ATGACCACTG AAGCACAGCA TCACAGGGAG ACGGTTAGGC CTCCGGATAA
211301 CCGCAAGCGA GCTTGACTAA TGTCAGGCCC TCCACAAGAG GTGAAGGAGT
211351 AGAATCTTCT CTAAACTCCC CTGGGGAAAG GGAGACTCCC TTTCCCGGTC
211401 TGCTAAGTAG CGGGTGTTTT TCCTTGACAC GCTACCCTTA GACCACGGTC
211451 CGCCTGGCAA CGGGCGTCTT CCCAGACGCT GGCGTTACCG CTAGAGCAAG
211501 GAGCCCTCTG GTAGCCCTGT CTGGGCATAA CAGAAGGCTC ACACTGTCTT
211551 CTGGTCACTC CTCACTATGT CCCCTCAGCT CCTATCTCTG TATGGCCTGG
211601 TTTTTCCTAG GTTATGATTA TAGAGGGAGG ATTATTATAG TATTGGAGTA
211651 AAGAGTAATT GTTACAAACT AATGATTAAT GATATTCATA TATAATCATA
211701 TCTAAGATCT ATATCTGATA TAACTATTCT TATTTTATAT TTTATTATAC
211751 TGGAACAGCT CGTGTCCTCG GTCCCTTGCC TTGGCACCTG GGTGGCTTGC
211801 CGCCCACATT TATCTTCTTT TATAGTTTAT TAATGCTCTG ATAATTTTTC
211851 TTAATATTGA TACAAGACTT TTCTAATCTT CTGGGTGCTT CTTTCTGTGG
211901 CCTTGGGTAA TTTTCTCACA CATATGTACT AATCATCACT TGGTCAAGTA
211951 TTTGAGGAGG CACTCCACAA ATGCAGTTTT TTTTCTTTTG CCATCACTCT
212001 CCTCTCTAGT AATCTATCTC CTGTGAACTC TTTCAGTTCA CGGCTGGAGC
212051 TGTGACTCCA GCTATGTTTT CTCAACACAA AAAGACTGCC TGTCTCTACC
212101 TCATTTCCTT CTCACTGTGT TGTAGCCTGG ACACTTTCTT TATGCATAAG
212151 TTGGAGCAAT GTTGGGGCTG ACTTCATTTT ATTCCTTTGT CTTGGGGATT
212201 ATGTGTTTTC CTCCTTTTTC TTAGTTGTTT CACCAGTAAG TACATATTTA
212251 TTCTCTGTTA TATCTCTGTG GCCAGAAGTC CTGATAGAAC AGATTTAATT
212301 TATCAGATTT TTAATAAACT CGAGAACATG TATATACACA CAATATATAC
212351 GTGTATATTA TGTATATATA AAACATATAC ATAATTATTA TATTTTTGCT
212401 TTTCTTTGTA AGTTTGTGTC TGTGATGTTT ACTGTGTGTA GTATTTGTAT
212451 ATAGGTGTCG TCATTTGAAT CATTGGTCCC AGTTTTTCAT TTCTCCTTGT
212501 ATTCATGCTT TTTCGCATAT AACTTTGAAG TTTTTTCCAC TAAAGCACAA
212551 GTGCTTTTCC AGATTCCTTG ACTTTGGCCT TAGCAATAAG GTTTGTTTGG
212601 GCCAATGGAA TATGAGTCTA AGTTGTAGTA TGCCAGTTCT GAGCCTATGC
212651 CTCAAGTGGC CTAGCTTCTT TTTGCTTGCT CTATTATACC TCTGTCAATA
212701 CCAGGAGCTT TCCTAGTGTT TTCTGGTGCA GACTGAGCCC CAACTGCAAT
212751 GAAGATTGCA ACCAGCCAAG ATCCACAGAC TGAAGCAGTT TCCTGCCATG
212801 TGCAGGCTAG TTCAGATGAC CTCAGTGAAT CCCCAGAATA AATGATAGAG
212851 ATGAAAAATA TAGATATATG CGGATTCACT GACAATAATA AGATGAATAA
212901 TGCATGCAGA AATTTCACAG ATCAGGTCAT TATAGCGAAA TAATAGGACA
212951 ACATGTTATG TAACTCTGGA CAAGTAAGAA AAATAATATT TCTAGGGCAG
213001 TCCAGTTTAC AAAATACTGA AATGGACCTG CAGAGTACCT AAGTCTGTTG
213051 GAGCATAGAT GAAGAGTCAA GAAAATGCAG GATGGAGAGA CAGAGCTATA
213101 GCAATGCTAA CAAGAACAGA ACACTAAGAA TTGTAGTTTT GTGGTCAGCA
213151 ATAGGGGTCA TGATGTGATA AATGCTATTA TCCAGACTGG AGCACAGTCT
213201 CTGTGAGTTA CCCAAAAAAG GTTTCACAGG AAGAGATTCC CACTGGTCCA
213251 GTACAGTAAC TTCTCCTAGC CATTTGGATA AAAATTTACT TGCTAAAGGG
213301 GATCTCAAAA TATAGACACA CCTTTAGGTT TTTTTAAATT GTTTTTATAT
213351 AATTTGCATA TATTCCCCTT AAGAGTCTGT TCTTAACCCA TTTATTATGC
213401 CTAGTGATCC GTTATTGGAA CGCTAAGCTT GTGGGAGTTA TTTATATCCT
213451 ACTGCTCAAA GTCATCACCA AGGTTTGATT TTTTTTTTAA AAAGTCAACC
213501 TCTGGCATAA ATGGGTTAAA TCGTTGTTGA TAAAGTGTTT TCTTCATTTT
213551 AATGAATTAC AACTTATAAA AAACCTTCAG CATAGATATC TAAATATTGT
213601 GGTCCTTATA TTATTCTTAG AATGAAAAGA CTTGCAGCCA GAGTGGCCAA
213651 ACAGGTAACA CTACTTTCTC ATAATTCATC AGCAAGTTTA AAATGTACTG
213701 CAAATGTGTT CCTTCCTCTT GATCACTATT AATTTCATAG GTTAAACTTG
213751 GACTGTATAG CCTAACAGTT CCACATTTGT GCCCCAACTA TTCATTTTCT
213801 AAGAAGCAGC TGGTCGTTTC TTTTATCTTT CTTTTGCTTC GTTTTATCTT
213851 TAAAATAATA TCCAAACTCA GGGTCATGGC TCAGGATGAC CTCTTCTCCT
213901 TCCAGGATCT AGCCGTTGCC TGCCCCTACA CCTTCATCTC CAACATTGGC
213951 CTTACTTCCT GTGACTACTC TGTTATTCCC ATCACTCATT GTTTAGAACT
214001 CTCGAAATTT CTTCCTTTAG GGCCTTTGCA TTTGTTGCTT CCTCTGTCTT
214051 AAGTATCTCC TCTTCTGTAT GAGTCTTCTA GGGCTGCCCT AGCAGAATGC
214101 CACAAATTTA TGTTTTCACA TTTCTGGAGG TGGAAAGTCA AAGATCACGG
214151 TTATGGCAAG GTTAGTTTCT GGTGGGGATG CTCTTCCTTA CTTGCAGAAG

FIGURE 3KKK

214201 CCCACATTCT TGCTGTGTCA TCACATGGTT TTTCCTCTGT GCTTGTGCAC
214251 TTGTCTCTTC TTCTTATCAG GACAACAATC CTATTGGTTT CAGGCCTGAG
214301 CCTTATAACC CTATTTAATG TTAATAACCT TTGTAAAAGC CCTATCTCAT
214351 ATCACATTGG GGGTTAGAGT TTCAACCTAT GCATTTTGGG GACACAATGT
214401 AGTCTATATC ACCTTGCCTT ATCCTTTGCC ACTTAGATCA TCACATGGTC
214451 GATGCCTTTT CATTACTCAG GTGTTATTTC TAATATCATT TCCTTGGAGA
214501 GTTCTCCCTC AACTATTGCT TAATCACAGT GTATTGTAAC TCTACAGGAC
214551 ATGTCTGACC CTGTTCACTC ATCACTAAAA TTACTATATA CAACCAGAAT
214601 TGTGCTTGAC ACATATAATG AAGCATTGAG AAAACATTTG TTGAATAAAT
214651 GTTTTCTTCT AATACTGGTT TATGGGCATA ACTATTTCTG AATGTGTCCT
214701 TTCTCAAAGG TAGACACCTG AGCTTTATGA TCCATGGTGT TATCCTAAAA
214751 AACAGAACAC AATATTATTA TATTAAGTAT ACCACTGAAT ATAGCAATTG
214801 GTGTCTTGAG GAGTTACAAC ATGTCATTAT TTAAATAGGT TATCATATTT
214851 TTTCCAGTAA TCACCCCAGC TATATTAAAA TGAAACTTCT CCCCTTTTTC
214901 TCTCTAGGTA GCATCTTCCT TGACTCTTTC TTAGACAGAT GCTATAACTT
214951 TTCAGCTACT TGAGTTATTA GTTTATTTCA TTATTTATTG ATTTTAAAAT
215001 GCCAATCTCA AATTATACTC AAAGGTTTTT CTACATTTCC CATCTGTGAT
215051 GACAGCTCTT ATAGCTTTAA GAGTACTAGG TTGTGGGTGG GCTTCAAGAC
215101 ATCTCTTTTC ACTCCCACTT CTAGATGCCA GCTCCATCTG TGATATGACA
215151 AGAGCGGGTA AATATCTTCT TACTTGACTC AATCAGATTG CAGTCTTCTT
215201 TTCCTTGGTT GTTGCTTCTC AGGCTGACAC TTACTCTAGA TGTCCTCTGC
215251 ATGGTTGGGC TCCTAATTCC TGTAATTCTG AATGGTCTCC ATGTACTTTC
215301 TTTTAGAATC ACCTAAGAGG TGTTCCACTT CTTGGGTCAC TGAAAGAGGC
215351 TGGTCAAGAT TCAAATCCAC TTATTTAATC ACTTTATTCT TGGTTAAAAT
215401 CCAACAAAGA CTGATCCTAG CATACCTTTT CTTTGTTTTC TGCCTGAATG
215451 AGTATTAGCA GGCCAGCTTG AGCACAGCAG CATTATTTAC ATCCATCATG
215501 CCCAAGAGTA GTTCATATCC TTGCTTCATC AAATAGGAGG ACAAGTTAAT
215551 TACCAGAATT CCTTATCTTA GCACCTCCAT CTCTCTGTTG GTCATTGCTT
215601 TCATGCCGGG GCAGCAATAA AGTATCTGTG GATCCAATGC CTCACTAACT
215651 CTTTTTTGTT TCTGAGATGG AGTCTCATTC TGTTGCCCAG GCTGGAGTGC
215701 AGTGGCGCGA TCTTGGCTCA CTGAAAGCTC CACCTCCTGT TTTCAAGCAA
215751 TTCTCCTGCC TCAACCTCCT GGGTAGCTGG GACTACAGGC ACATGCCACC
215801 ACACCTGGCT AATTTTTTTG TATTTTTAGT AGAGACAGGG TTTCACTGAG
215851 TTAGCCAGGA TGGTCTCGAT CTCCTGACCT CATGATCTGC CTGCCTTGGC
215901 CTCCCAAAGT GCTGGGATTA CAGGCTTGAG CCACCGCTCT CGGCCCTTTG
215951 TTTTGTCTTT ACATCTCTTT TTCAAATTTG AAATTATTTC TCATGAGAGA
216001 TTGTCCCTAA CCAGAATATT ATTTCAATTT CAAGTACTTT ATTCTTATTT
216051 ATTTTTATCT TTATAATTTA CCTTCTAAGA TTTTTTTCAT GTTCTTATTT
216101 TGCTACTATA TATATTTACT TAGTTATATG TTAGATATAA TATTAGCAAA
216151 CAAGACTAAT ATCTATTATC AGGGAAAATA GGTTTTCAAC TTTATAGTAT
216201 ATGACCTTTA GAAGTAAAAT GTTAAATTTT TTTTTTTTTA CTATTTTACA
216251 ATGTTTCTTT TAAAACTATT TCCTATTTAT ATTCATTTAG ATTTAAAATC
216301 CTCCAATAAG GAAATAACTT ATTTTCTCTG CTGAAGAGTT GTAAAATTCA
216351 ATTATGCATA AAGACAAACA TCATCCTGAG TAAAGAATCA TCCGTAAGAT
216401 TAGCGGAATG AATCTGCTGC AACATTTACA CTTCATACTC TGAAATTGAT
216451 TTTTATGCAT TTTAATGGAA GCAATATTTT GCATTTGAGT ACATTACATA
216501 GGAAAATAAA ATGTCAAGGC TTATTCCTCA CAGAATTCAC AATCTCCGTT
216551 TCTGTTTCTG TATTTTTTTC TCTTTTTACT TAGAGGAATT GTTATGAGAT
216601 GATCTAGTGG TCAGTTCATT TCTCATTCTT TTAGAACAAT AATTTGCACA
216651 TTAAAGTCCT AATACAAATA AATATACCCT ATGTTCCCAT CTGTTATTCT
216701 TACTCTATTG AGACCTAGTA TAAGAGTAGA GCAGTAAATG GAATACAGTC
216751 TTACTTCTCA ACCATATCTT TTTTTCAAAT GGCAAAATAT GTAAATATTT
216801 CTCATATGTT TAAATTTTTA CTTTTATTTG AAACCACTAA TGCCCAAATA
216851 ATGCATTGAT CTCAGTCATG GGAAGAGGTG GTAAGATATG ATTAATATGT
216901 CTTTATTGTA GCTTGCTGTG ATTTCATGTA AAGAACATGC CATTTTATGA
216951 CTCTTACTAG TGTAATGAAT AAGTAAATTT TTAGCTTTAG AATTAATGCA
217001 CATACCCTGA CATTTTATAT CTAATTGATC TGAAAGAAAT TCTAAAGAGA
217051 GTTAAACACT TTAAGTTCCC AAACATGAAG AATTTGAATA AAGCATGAAA
217101 GGAACAGAGA GCTATTTGTT GTTTACTTTA TTCTTTGAGA AGCTAAAACT
217151 CAGAATCTAA AGCACAGAAG AAAATGTCCC AATTTTCAAA ATCAAGAAAT
217201 CAAGAATCAT GTTTACATGG TTTTTTTAAC TCACACTTTC TATGAGCCAA
217251 GTGTTGTATT TAAAGATATT TCATTGAACA TATTGGACAC AGTTTCTTCC
217301 TGCAAAGAGT TAACATTTGC AAAGCCGTTC CCTTATTACT TCCTGGATAT
217351 TTTTTCCTTC CTATTTTAGT GTTAGATTAT TTTAAGTGAC TCTTGATTCT
217401 TATTTTTTTA CTTGAAAAAT ATGGAAAAAC AAAACAAAAA CTACCATTTA
217451 GTGACAAACT ATCTGGTTTC CAAAAACCTG AAAAATTAAA ATAGTTTTTG
217501 TATAATAATA AACCCATGTA AGAAGTTAGT TATGATTTAA TGGAAATGCT
217551 GCCTCTGTAT ATGTAATGTA AAGAGGGGGC AATGTAATTT ATTGATGAGG

FIGURE 3LLL

217601 CATGCAGGCT CTGGATTTCA GATTGACTGA GTTCTAAGCT CAGTTTTGCC
217651 ACTCACAGGG CAAGCTGTTC AAGCACTACA ATATAGGAGA GAGAGCAATA
217701 CCTATGTCAT GAGATTTTTA TGAGGATTAA ATGAGATAAT GTACATAGGA
217751 GATTTAGTAA AGCACCTCTC ACTTCGTAAG CACTCACCAT TATTATGCAA
217801 CATTTCAACA CTTTTTTAAT AAAAAGTAAT TTAAAACTAT TAGGGAAGAG
217851 TGAGACAGGA AGAGAAAGGG AGAGAGAGAG AGAATGAGTA AATAGGATTA
217901 ATGAAAGAGT TGAGTTTAAA AAGTCTCTGA TATTAGTACT TTGGGTAGAA
217951 AAATTTTATA CTAGTCTTTT GCCAGATGCA TAGTTACTAA AAATTCTGTA
218001 GGTTGTCTGT TCATTCTGTT AACAGTTTCT TTTGTTATGC AGAAGCTCTT
218051 TTCATTAATT ATATCCTAGT TTTTGCTTTT GTTGCAATTG CTTTCAGTGT
218101 CTTCATGAAA TCTTTGCCCG TGCCTATGTC CTCAGTGGTA TTTATGGTTT
218151 TACATTTAAG TCTTTTTTAT TTTTTAAAAA CAGTCTCACT CTTTCGCCAG
218201 GCTAGTGTGC AGTGGCGCGA TCTCCGCTCA CTGCAACCTC TGCCTCCTGG
218251 GTTCAAGCAA TTCTTCTGCC TCAGCCTCCC GAGTAGCTGG GACTGCAGGT
218301 GCACACCACC ACACCCAGCT AATCTTTGTA TTTTTAGTAG AGATGGGGTT
218351 TCACTCTGTT GACCAGGATG GTCTCGATCT CCCTGACGTC ATGATCTGCC
218401 CTCCTCAGCC TCCCAAAGTG CTGGGATTTC AGGTCTGAGC CACCACACCT
218451 GGCCTACATT TAAGTCTTTA TCCATCTTGA GTTAATTTTT GTATGTGGTG
218501 TAAGGTGGGG GTCCAGTTTC AATCTTCCGC CTATGGCTAG CCAGTTCTCC
218551 CAGCACCATT TATTGAATAG GAAATGCTTG TCTTGTTGCT TTTCTTGTTT
218601 TTATCAGGTT TGTTGAAGTT CAGATAGTTT TAAGTGTGTG GTTTTATTTA
218651 TGGGTTCTCT ATTCTGTCCC ACTGGTCTAT GTGTCTGATT TTTTTTTTTT
218701 TTTTTTTTTT ACCAGTACCA TGCTGTTTTG GTTACTGGAG CACTGTAGTA
218751 TAGTTTGAAG TAGGGTAGTG TGATGCCTCC AGCTTTGTTC TTTTTGCTTC
218801 GGATTGCCAT GGCCAATCGG GCTCTTTTTG GTTCCAGATG AATTTTAGAA
218851 TCCTTTTTTC TAGTTCTGTG AAGAATGTTA ATGATAGTTT AATGGGAATA
218901 GCATTGAATC TATAAATTGC TTTGGGCAAT ATGGCCGTTT TACCAGTTGA
218951 TTCTTCCTAT CCATGAGCAT GGAATGTTTG TGTCATCTCT TATTTCTTTG
219001 AGCAGTGGTT TGTAGTTCTC CTTGCAGAGA TCTTTCACCT TTTGACTTAG
219051 CCATATTCCT AAGTATTTTC GTCTTTTTTT GTGTGGTAGT TGTGAGTGGC
219101 AAATTGTCTG TGACTTGGCT GTAAGTCTAA TATCCTGCAT TTGTAAAGAA
219151 CTTAAAGAAA TTTACAAGAA GACAACCCCA TAAAAAATTA GGCAAAGGAC
219201 ATGAATAGAC ACTTTTCAAA AGAAGACATA CATGTGGCCA ATAGAAAGAA
219251 AGCTCAACAT CACCAGTCAT TAGAGAAATG CAAATCAAAA ACTACAAGGA
219301 GATACCACCT ATCACCAGTC AGAATGGCTA CTATTAAGAA GTAAAAAATA
219351 ATAGATGCTA GCGAGGTTGT GGAGAAAAAA GAAATCATAT TTATACACTG
219401 CTAGTGAGAG TGTAAATTAG TTCATCCATT GTGGAAGACA CTGTGGTGAT
219451 TCTTCAAAGA CCTAAAGACA AAAATACCAT TCAACCCAGT AATCTCATTA
219501 CTGGGTATAT ACTCAAAGGA ATATAAATCA TTCTATTATA AAGTCACATG
219551 AATGTGTATG TTCATTACAG CACTGTTCAC AATAGCAAAG ACATGGAATC
219601 AATCTAAATG CCCATCAGTG ATAGACTGGA TAAAGAAAAC GTGGTACATG
219651 TACACCATGG AATACAACGT AGCCATAAAA AGGAATGCAA TTATGTTCTT
219701 TGCAAGGATT TGGATGGAGC TGGAGGCCAT TATCCTTAGC AAACTAACAC
219751 AGGAACAGAA AACTAAATAC CGCATGTTCT CACTTATAAG TGGGAGCTAA
219801 ATTATGAGAA CACATGGGCA CATACAGGGG AACAACACAC ACTGGGGCCT
219851 CTCAGAGGGT GGAGGGTTAG AGGAGGGAGA GGCTCAGGAA TCACAAGTAA
219901 TGAGTACTAG GCTTAATACC TCGGTGATGA AATAATCTGT ACAACAAACC
219951 CCCATGACAC AAGTTTACCT ATGTAATAAA ACTGTACCTG TAACCCTAAA
220001 ATTAAAATGT TAAAAAAAGA GTAGCCACTA GAAGATAAGC CACCTCCAAG
220051 GAAAAAAACA CCTCCAAGGG AAAAAAAGGA AACAGATGTA CTTTTTACAA
220101 TAGAATGTGT TGATTCTTCT TGAAGAATAC TAGTGTCAGT AGGATTTTAG
220151 CTATTTTTAG TCTGCTAAGA ATTGGCATGA ATAGACATTA ACAGGTTAAT
220201 GAAGTATCTG AAAATAAGTG AATCCAGTTG CTGTTTAATG TCCCAAACTC
220251 AAACTTTTAA TGCTTTATAA CAGTCTCAGT TCCTTTTATA ACTGCGAGGA
220301 AATAGTTTCT TTCCCAGGGG CATACTGCCT TTTAAAAAAA TGTCTATTTT
220351 TATTAACATC CCTTTGTGGC CGTAACTACT ATTAGGAAGT TGGAGTAAAT
220401 TATCTTACTG ATGACCTATT TCTGTTTCTA ATAGTTCTTA ATCAAGAATG
220451 ATATGCAATT GGGACACAAA TTTTCTTCCT TCAGACTTAC TCCAAATTCC
220501 CGTATCCTGG TCCCCAAGGT GGAATTGCGT GTCTAGAATT CCCTTTAAAA
220551 CTGTCAATAG CCGAATTTTC TTTTATTACT CTCTGGCACT TTAAACAACT
220601 TTGGCATCAT TTAAGAATTT TGATGTTTTA TTTTGAAGTT CCAAAAGTGG
220651 GAAATAAAAG CATGCGGAGG GTAGGATTAA CAATACTTGA CTGGACCATC
220701 TAGAAGTGAC TGAAGAAACT GGTTTTGTTT ATATAGAGAG GAGAAACCCA
220751 AAGACTGATT TAGTAACTAG CTATATAGAG GGCAGAACTA AATTACTGCT
220801 TTAATTTCCC TGGTGAATTT GTAGAATTTA ACCACTTTAA ATAACAGTAT
220851 CCCCATTTGC AAGATGAAGA TAATATTTCT GCTTTATGAC TGTTTGGGGA
220901 GGATTAAATG AGACAATATA GATTAAATAT TGAATATAGT AGCTGTAATA
220951 ATAGGAGCTC AATAAAAGTG TCTTCCTTTC TTTTGTCTTC TTTAATAGGT

FIGURE 3MMM

221001 GGTATGATCA CTATGGATAT CAAAATGGGA AGTTACAGTT GCGATTACTT
221051 AAAACATTCA GAAACATTAT CTGCTATGGT GGTTAGCTGT GGAATATCCT
221101 TTCTCTTTCT CTTTCCAAGG AAAAAAATTG CAAAATTGAT TTTTAAGGAA
221151 CAAGTACCAT GATCTTCACA ATCAAATGTT ATCTCTAATA GAGTTTAAAA
221201 AGTAATGGTG ATGATTTTTC AGTTTATTAA AGCTGGAAAA TCATTATTCA
221251 TGTGCTGTTT ATAGATGTTA TTTAATTTTA ATATCCTAAT AAGATGCTGT
221301 AATTAAAAAT GGTATAAGTG AAATATGATT TCTCATTAAT ACAACTTATT
221351 AATAAAATAT TTATATTCTT ATGGATCATA GTAAAATATG AACATTATGT
221401 CATTTGATAA TTTTTGTTTA ATTCTTGATC TGTTAAATGT TTTTAAGTGT
221451 AAGCAAACCT TTTTGCTTGA AGATGAACAT TCACCTCAGA GTTAATATAT
221501 GTCTTCCTTT TTCTTTTAAT CATTGGATAT AATAGCTTCA AACATTTATA
221551 AACAAGAAGG AAATGAAATA TTGGAATTTC ATAAAATAAA AACAAAAGTT
221601 AGAACATCGA CTTAAGTATA TCAAAATTGG AATTAAAGTT AACAGTTCTT
221651 GCAAAATAAC AATAAAATTC TAATATGCAT GGAATAGCCT ACTCCACATT
221701 TTGACTAAAT GTAGAAACAA AAGTTAGTAA ATATTATTTT CTTTGTTAAA
221751 ATATTGAGTT AGCTAGATAT AAACAGAGTA ATTTGGTAAA AATTATTTTC
221801 TAAATTCCAG TTTTATTACA GCTTCTAGTA AGATCAAGTT ATAAAAGTAA
221851 AAATTATTAT ATAATTACAT ATAAATTACA TAAAAATTTT AAAAGTTTAA
221901 ATCCCCTGTG ATGTTTTTAA TAAATTTATT TTAATAAAGA CCATTTTTAA
221951 ATTTATTTGA AGATAAATGA GGAAAAGGCC TAAAATAGTT TATGTAAGAG
222001 AAATACTAAT TCTCAATAAG AATTATGCTG AAAGAGAAAA GCTAGAAAAA
222051 AATACATACT GAAGCACAAA ATAATACATA ATGAATGATA CATAAATATT
222101 TAGAAAATGT AAACTATTCT GACAGAAAGC AGACCAGTAG TTAACTGGAG
222151 CAGAGTATGT AGGGACAAAT GAATTGCAAA GAGGAAAAGA AATTAATGGG
222201 GGTGATAGTA ATATTTTGTA ACTCTGTTGT GGTGGTTTCA TCAAAATTTA
222251 TTGAATTGTG TATTCATCAA ATTGGCTGCA TTTTGCAGCA ATCATATCTC
222301 ATCAAAGTTT ATTTAAAGAA CAAGAACAAT AGTTTCACTT CTTTAGTTTT
222351 GAAGTAAATA AAGAAAATAT GAAGGCACTA TTTTTATTAA CCAATGGATT
222401 AAAAAATAAA ATGAAACCCA AAAAATTAAC AATACTGGTA TCATTGAAAT
222451 CTATGAAGAT GGTGGCAGTA TCAGTTGGTC AGACTTTTGG ATAAGCAATT
222501 TGGTACTGCG TCTCCAGGTT CATCAAAAAT ATACTTACCC TTTGACATAC
222551 CAGTTTTGCT CTTATGAGAT TGTCAATAGA ATGATCCAGA AGGATAAAGT
222601 GACATGCAAA AAGACTTTCT TTTCTGAGTA GGTTATTCTA GTAGTTTTGA
222651 ATCTTAGTCC AGATATTCAG CTGTGCAAAA AATATCTTTC CTTTCTCCAA
222701 ATCAGTTGAA TCTATTTTTT ACGTATTTGC TGAGAAGGCA GAAATTTAAC
222751 TTGAGTTATT ACTACTGACT TCACCAAATT GTGCCAAGTT GCTGAAGCCT
222801 AACTTAATAC CTATGAATCA GGGACACTCA TCAAATCATT TGCCATTAGT
222851 TCACACTGGA CCCCATTCCA GCCTGTAGCA TTCAGAGATC TGCTATGTTC
222901 CTGCCACTCT CTGAGAAAGG CCATCTTTGG AGGACATGAG GTACACTCTA
222951 CCTAGAAGCT AGCCTATTTG GTGTTCCAGG TAGCAATTCC TTTGATGTCT
223001 TGCCGTCATC CAGAGTTAGA GCCATAGAGC ACGGGTTATG TCTCCCCTAC
223051 TTCTGTAACC CCTTTAGTCT CTAACTTTTT TCTCCTCCTT TTCCTTAGCC
223101 ACTAAAGTTC TCCTAACCTC TCTTCCCCTT CCAGAATATC TAGCATAATC
223151 TTTTTAGTGA GCTTGGCTAC TTCTTAGAAC TTGGGTGTAG AGATGTGTGT
223201 GGTGCATAAT TATTACCTCA TAAATTACTC CACTAAATTT GTTTTAATGA
223251 GGAGTTTGTA AATGCAAGGA ATTAATTAGA AAAGTATCTA GTGGGTGAAA
223301 TATTATTGCT AAAATTGAAG AATAGAAGCA GAATACAAAT TTATATCTAC
223351 TATGAATATG ATGTCTTAAG AATCATGTAT ACTATTTGTA ATGATGAGAT
223401 AAATTATGAG AGTTTTTCTA TCGCCATAAA CTATGAAGTT GTGTGGGTGT
223451 GTGTGTAATT TCTTAGGAAA AATGCATGTG TGTTATTTAA CATACTAATG
223501 TTTGAGTTGG CCAATTTAAA TTCAAAGAGT TAAAGAATAC CGATTGATCA
223551 TAATTATGAG GTCATCCTTA TTATATAAGT TATTCAGGGG AGGAGTGACT
223601 GTGAAAATTT GAAGAAAAGT TAAGAATTTT TTAGAAGTGT ACCAGTACCG
223651 GTACCAAAAC AGAGATATAG GCCAATGGAA TAGAACAGAG CCCTGAGAAA
223701 TAATGCTGCA TATCTACAAC TATCTGATCT TTGACAAACT TGACAAAAAC
223751 AAGCAATGGG GAAAGGATTC CCTATTTAAT AAATGGTGCT GGGAAAACTG
223801 GCTAGCCATA GGTAGAAAGC TGAAACTGGA TCCATTCCTT ACACCGTATA
223851 CAAAAATTAA TTCAAGATGG ATTAAAGACT TAAATGTTAG ACGTAAAACC
223901 ATAAAAACCC TAGAAGAAAA CCTAGGCAAT ACCATTCAGG ACATAGGCAT
223951 GGGCAAGGAC TTCATGTCTA AAACACCAAA AGCAATGGCA ACAAAAGCCA
224001 AAATTGACAA ATGGGATCTA ATTAAACTAA AGAGCTTCTG CACAGCAAAA
224051 GAAACCACCA TCAGAGTGAA CAGGCAAGTT ACAGAATGGG AGAAAATTTT
224101 TGCAACCTAC TCATCTGACA AAGGGCTAAT ACCCAGAATC TACAATGAAC
224151 TCAAACAAGT TTACAAGAAA AAAACAAACA ACCCCATCAA AAAGTGGGCA
224201 AAGGACATGA ACAGACACTT CTCAAAAGAA GACATATATG CAGCCAAAAA
224251 ATGCATGAAA AATTGCTCAT CATCACTGGC CATCAGAGAA ATGCAAATCA
224301 AAACCACAAT GAGATACCAT CTCACACCAT TTAGAATGGC GATCATTAAA
224351 AAGTCAGGAA ACAACAGGTG CTGGAGAGGA TGTGGAGAAA TAGGAACACT

FIGURE 3NNN

224401 TTTACACTGT TGGTGGGACT GTAAACTAGT TCAACCATTG TGGAAGTCAG
224451 TGTGGCGATT CATCAGGAAT CTAGAACTAG AAATACCATT TGACCCAGCC
224501 ATCCCGTTAG CTGGGTATAT ACCCAAAGGA TTATAAATTA TGCTGCTATA
224551 AAGACACATG CACACGTATG TTTATTGTGG CACTATTCAC AATAGCAAAG
224601 ACTTGGAACC AAGCCAAATG TCCAACAATG ATAGACTGGA TTAAGAAAAT
224651 GTGGCACATA TACACCATGG AATACTATGC AGCCATAAAA AAGGATGAGT
224701 TCATGTCCTT TGTAGGAACA TGGATGAAGC TGGAAACCAT CATTCTCAGA
224751 AAACTATCGC AAGGACAAAA AACCAAACAC CGCGTGTTCT CACTCATAGG
224801 TGGGAATTGA ACAATGAGAA CAACTTGGAC ACAGGAAGGG GAACATCACA
224851 CACCAGGGAC TGTTGTGGGG TGGGAGAAGA GGGGAGGGAA AGCATTAGGA
224901 GATATACCTA ATGCTAAATG ACGAGTTAAT GGGTGCAGCA CACCAACATG
224951 GCACATGTGT ACCTATGTAA CAAACCTGCA CGTTGTGCAC ATGTACCCTA
225001 AAACTTAAAG TATAATAATA AAATAAAAAG AATAAAAAAA AGGATGAGAC
225051 CCATTATTTT GCTTGCGAGC TAGATCCAAA TATGAGTCAC TATCTTAACT
225101 GTGGCCAGAT CCACACATGA AGGTCACAAT TCCTATTTTG TGTATTTACT
225151 TGTTAGACTC AGGACCTTAA GAGTGGGCTT TTGAAATACG AAGTGATAAA
225201 AGTATTTACT TTCACCTGTG TGTGTAATCG AGAATTCTAA TCTGAACTTC
225251 TTGCTGATTC TTGTCATGAA ACTCTCTGTA CCACCCAAGG AGTTTACACA
225301 CTATGAGGTA CTGTTGTAAA GTTCTGTGAG CTTGGTACAA ATATTCAACC
225351 CCAGACCTTA CCTATTGCCC TAAGCCTAGC GATAAAAGGC AAAATATTTT
225401 TTATCGGCTG AATCGCAATA TAAGATGGAC AATCATGCCG GTGAACTGAA
225451 GTAAAGTATA TGTCATAGTC TTGTTTGTGA GCAAAAACTA GGCAGGGAGT
225501 TAACACCACT TAAATATTGT GCCAAAATCA TGTCACAATG CACTCTTCAG
225551 GTAGGGTATG GGAATCAGAG TCACATTAAC TGAGTGCTGG ACTAGGCAAT
225601 ATGAAACCTT CCCAAATGTG GAAAAAAAGA AAGAAAAAAA AAAGGAAGTA
225651 TACCAGTACC ACAACCGAGG AATACAGGGA ATCCTGAGCA AGCGGTATTA
225701 TGAGGAGGCT GCTGGAGACT CGGTACTCTT GGAAAGGTTG TTATGAGATG
225751 GCTTAGGGTA TAACAATTTA AGCTTTACTA TGTGTACCAC TTTATTGAAA
225801 TTGCATTTTT AATCACAATG ATTGTAGTTA AAGCATTCTA AGTGTGTACT
225851 GATAGTAATC AAATTATTCT AAGTTGTAAA AAACTTGTAG AAAATAATGT
225901 AGACAAAATT TAACCTAGGA AAATTTCCAA ACTAATTTTA GTGGTATAGG
225951 TGAGAAGCTG GTCAGTCGGT CAGCACGAGT AAAGAATGAA GTAACACTCT
226001 GAATTTATCC ACATATATCA TGGATCTTTA AGAAAATTCA CATAGAGATA
226051 TTCAAAACAA ATTATTTAAA GATCACTAGT GAGCAAACAA ATGAAAACAT
226101 TCTGGTTTTA CTCATAAAAA GTGGTAGCTG TATGATAGTG TTTGGCTGAT
226151 AAGAGTATTA GAATGCTGAA CATCCTCTAT AGAAAATTGC ACATATTCTT
226201 AACCTAGTAA CAATAAAAGA TGATGAGGAA TGTCAACTCA GATTTAAAAA
226251 CGAATCCTTA CTTCCAAAAG TGAGAGACAA ATAATAAATT AATGTTCATT
226301 CTATGGAAAT GAAATTGAGA TTCAAGTAGA CCATGTATTT GATAAGAGCC
226351 CCAAATTAAA GCTGTATAGT TCAAGACTAT AAAATGCTGT TATGTCTAAT
226401 CACCCCCCAA ATTATAATAC CTCTTTTGTC AAGTAATGAA AACTTGATAT
226451 AGAAAAGGAT ACATCAGGCC GTTGTGGTTT TAGAAATCAA ACAATATTTT
226501 CTGAGAATTG TTCTGAGCTA AAACAATAAC AAAACCTCAG ACTTTGGATT
226551 TGAAAGGGTT TACCTTAGTA GTCTGTTTAA TTTATTTTTT AAACTTATTG
226601 CTGACCACAA TCTGCCCATC TGTGTCACAT TATAAAATAT ATTCTAAGTC
226651 TACAGTCTAA TTGGGAATAT AACTTTAGGA ACATGGGAAC TTTAGGGAAA
226701 AAGAAACTTT CTTGACAAGG TTGTATTTAA GCATTCTTTA CTCAACTGAC
226751 ATAATCAAAT TATTCTGATA AAAATGAAAA TATAGTAATT TTTGGATTAT
226801 AGTTTCATGT TTCTATGAAA AACAGTTTGA TCTTAGTGAT GAATTTTGTA
226851 CTTTCTGACC TCCAATGTGA TGTTAATGTG AACAGATCTG GGCAAACTAA
226901 ATTCTGCTTC TGTTCCTTGG GGAGAGTTTT ACAATCTTTG CAATTATCAG
226951 TGCCATGGCT GTACATGATC ACAATCTCAA TATTTTCAGT GTTATAGACT
227001 TAATATATAA TTCTTTTACT GTCCATGAAA ACACCATTGT GAGCAGTTTG
227051 TTCATCTAAT GAATCTCTTT CAATTTCTCT ATTGACAAAT GTGTTCTTTT
227101 GAAGGTTGTA TCCCTTGCTT AAAGTCACCT CCAGCTATAA ATTATTTTTT
227151 AAAACATCAA GAACTCAGTT GTGTCTGAAC AGATGACTTT TTGGATTTTC
227201 CTTTACCTGA TTGCTTAACA TCACCCAGGT TTAGGTATTA TTTTTAGCAT
227251 ATTGCCTATA CCAGTTGTTT TCAAATTAGC ATAAGCAGTC TACTGAAATG
227301 GTTATGTGCA CACACACACA TACACATACA GAGTACTGTT TCTATGTTCC
227351 AGATTGAATT GTTCATGGAA CTACGATATA GAAATCACGG GAGAGGTCCT
227401 CTTGTACTTC CTTTTGAACT TTTCTGAGAC CTCAGAGCAA TTAAGGTTCC
227451 TCACACAACA GTTTGAAAAC TTCCTTTATC ATTATACTGT TTGGTAAAAA
227501 TTCTTTTGAA AGAAATAAAA TGGTAACCAT ATTTTTACAT ACAATAGTTC
227551 CAGAATATTC TGCCAAACTT CTAAGAATAA TTTAAAAGTA GATTTAAATC
227601 CTATTCCTTC TTTTTAACAC CCTGACTTTG TTTTGCTCTC AATTAAGATT
227651 TTTTAGAGTT TCTCCAAAAC TCCTTTTAGA AATAAGCGAA ATCCTATTAG
227701 AAGCATGTGA AATATTTATA TGGGGTCATT ATTATAGGTC AAAACCACCC
227751 AGTTTTCCTG AAAAGAAGTA CACAAGCACT CCAGCAATTT CCACTGTTAT

FIGURE 3OOO

227801 TTTATCTAAC TCCTCTCAGC TCCCTTTTCC CCTGTCTTCT TTTTTCTTAT
227851 GCTATATTAA GTACCTTACC TTTTCTGCAA GTCTCTCACC AGGATGCTTT
227901 GCAGATAAAA TTTCCCTTTT GGGTAAAATG GGACAGATGA GAAGTAGGTT
227951 TTGGTGGTAC ATAACTTTAA TAGACACTAG GACTTTTTAC ATAGTGCCCT
228001 CTTATCATTC TTCTTTTTTT CAATATCTCC TCAACTATAT TTTGAAACAG
228051 TGATATGCTC CTTCTAGTAT TGTAAGTATT GCTTGTTTTT TGATTCTTTG
228101 CTATTACTTC CTTAATGATA AAATTCTTCC CTACTTACAG TTCTATTTTT
228151 GAGATTTTGG CCTTCAACAC TATAGGATTT TTGTAGCGTA CTCCATATTT
228201 GAAAATAATT TTCTTTATAT TTTCAACTTC TTACATGTAA AGACTGATGG
228251 TTCTTCATTT ATTGTCGGAG ATCTCTGCTT CTTGAGTTAC CTTGACTTGA
228301 TAATATATCT TGATATGTTA GTCATTTATA ATGTATCTGA ATGTTTCTTT
228351 GCTATGGTAA AATATATGAT AGTGCTTTCA TTTAATATTT ATTGTATTTT
228401 ATTAATTAGG ATGTTGTGGA CGGAATGTAT TTCCCCAAAA CCTCATATGT
228451 GGAAATCGGA TTCTCAGTGT GATGATATTT GGAGGTGGGG CCTTTAAGAG
228501 GTAATTAGGT CATGAAGAAA TGAACTCTCA TGAATGGGAT TAGTGCCCTC
228551 ATAAAAGAGG CTCCAGAATG CTTCCTTGTC CCATCTGCCT TGTGAGGATA
228601 CAAGAAGGTA GCCATTTATG AACAAGGAAG CAGGCCCTCA CCAAATACCG
228651 AATATGCCAG TGCCTCGATC TTGTGCTTCT CAGCCTCCCG AACTGTGAAA
228701 TACACATTTT TGTTGTTTAT AAGCCACCCA GCCTATGATA TTTTTATTAT
228751 AGCTAAAACA GACTACCATA AAGGGTGATT TGAAAAATAA AGTGTGAATT
228801 ATGTCTTTGA TTCTTTAAAT CAGTTTCTGT CTTGTTCTAT TTTTGGTCAA
228851 TTCCTATTTT ATAGAAATAG TATTAGGCCA AAGAGAGGAC TAAATATGAA
228901 AATGCTTTCA AAGATTTCAA AGAAAGGCAT ATAATAAACA CCAAATAGTA
228951 TAATAACTAT TAGTATCCCC ATTATTAATG TTGTTATTTT CTTCATGATG
229001 AGCAGAGCAA AATCATTATT AAAAACTGAG CTGTGAGTGT TTTTTGCATT
229051 TTAATCTTTC TGGCAATTTT CTTACCTAGC TTAAAAAGAT GACCCTGACA
229101 GCTAAGTCAA TTGTTTTTTT CTCCCAACTT GGACGTTCTT CTATTTGAGT
229151 CCCTTTGTAT ACACAAAGAA GGATTCAGTT CAAAGGAGAA GAGTCCTAGT
229201 TTTCAAGTGA CATTCTTGAG CTCTATTCTA GGCAGTACCC TTTGCTGGAG
229251 TTTTCCCTTG AACTAATCAC TTAACATTTT ACATTTACTT TCATCACCAT
229301 AAAATATGGT TAATAATCTT CCTAGATGAT TGTGACAATC ATTAAATGAA
229351 AAGGTATATG TAATGGGCAC TTTAGATCCT CTTCCTGTAT TTCAGTACTG
229401 AGCAATTGTA CCCATCCCTC AGTGCTGATT GTTGGCTGCT GATAGCTCAC
229451 AGCTGCTCCC TTCTCTAAAA GTTGCCATTG ACTGGGAGCT ACTAGGTCAG
229501 TTATGTGACT CGCCGACCCC TGGAGAATTC CATGGCCATT GATGGACTAA
229551 TATGAGAGGT TCAAAAGGTC AGACCCCTTC CTTTTTAAGT ATACTAATGA
229601 GGCAAAATGT TTGTTTACTA AAAAAATTAA AACTACCGTT GACTTAAAAG
229651 GTGTATTTGA ACAAACTAGA TGGTAAATTT CTTATCCAAA TTTATTAAAG
229701 CACTTACTAT GATTCATATC TATGCTATTT GCTAAGAAGA AAATGATAAT
229751 ACAAACATGG TCTTTGCCTT TAAGGACCTT ATATTTCAAC GTGGGAAGTA
229801 TGCACATACA CACAAATACA AACATACTTA TATACAAATC ACATTAACTC
229851 TTGGAAATTT CTATGACTTA TAAAACAGAG GATAACTAGA GGTCTAAACT
229901 TAGGGTAGTC AAGAAAGACT TAACTTTAAG TAGATGGCGG TTTGACTGAA
229951 ACCTGAACAA ACATGAAAGG GCTACTAATA AAGTACAACA GCAGAGAGAA
230001 TATCATCATA TGCAGTCTTT TAGGCAGGAT ATGTTTGACA TTTGCAAGAG
230051 AATACTGATG TGTCAGCAGT ATAGTGAGTA AAGGTGATTG AGGGAAGAGA
230101 TAAAGTTGAA AAGAAAGGTA AGATCACACA AGATTAAATG CCATACTAGA
230151 GAGTTTGAGT TTTGCTCTAC ATGCAGTGGG AAAACACTAA AGGATCATAA
230201 ATGCTGAGAG TGGAAGGTGA TATAATTTGA AAAGAGGAGA GCGGATCATA
230251 AGAGGAAAGA AAGGAAGCAG GAAACAATCT GTTGTCACAT ACTGGTTGAC
230301 ACGTCATACT GGACAGAATA AAGGCAGTGA CATACAAGAG GATATATGTC
230351 TAAGCTAATA TTTGCAGATG ATTCAATGTG GTAATTCAGG GCATGGAAAA
230401 TAATGTTTGC AGAAGCATTG AATGTTGGGT AAGAGGAGAA AGTGTGATAA
230451 AACAAGGGTA TGATGGCAAA AGATAGTGAA AAACTAGGAA AAAATGAGTT
230501 TCATTGTGAG CATGTTAAAT ATGAAATTGT AGTGAGGCAT TTATTTATTT
230551 ATTTATTCAT TGAGAGTACC AAACATGTTT AAGGATTGCA ATTTTTTATT
230601 GATACATAAT GTATATATTT TGAGAGTACA TGAGATATGT TTATACATTC
230651 ATATAATGTA CAAATATCAA CTCAGAGTAA TTGGGATATC CTTCATGTTA
230701 AATATTTATC TTTTCGTTAT GCTAGGAACA TTCAAATTAT TCTCATCTAG
230751 CTATGTTGAA ATGCATAATA TATTATTGTT AACTATAATA ATCCTGCTGC
230801 TCTTTTGAAC ACTAAGTCTT ATTTCTTTTA TCACAGTGTT TGTTGTTGCA
230851 GATTAATCAA TCCCTCTTCA TCCTTTCCCC CCCCATGCTT CCTGGACTGT
230901 GGTAACCACC AGTCCATTCT CTGTCTTCGT GAAGTCCAAT TTTTACACTT
230951 CAAATTATTA GTGAAAACAT GCAATATTTG TCTATCTGTG CTTGGCTTAT
231001 TTCACTTACC ATAGTGACCT ACAGTTCCAT CCATGTTGCG GCAAATGACA
231051 TGATTTTATG TATTTTTATG GCTGAATAAT AGTCTATTGT GTATATGTGA
231101 CACATTTTCT TTATCCATTC ATTCACTGAT AGGCAATGAG GTTGCTTCCA
231151 TATCTGATTT AAAGAGCAGA GTTTTCAGGA CTAAGCGTGG TAGTCCCATC

FIGURE 3PPP

231201 ATCCCCCTTT GTCTCTGGCT GTCCTCGGGA ATATTTGTCT CTTCAGACAC
231251 TTGCAGTGCT TTCTTTGGGT GTAGGCAGGG ACCAGACTCC TGTCAGGGAG
231301 CCCAGTGGGG AAGCTGGTTG TCTACTTCAG TCTTACTTTT TTTCCAGTGT
231351 GGAAATTGTG AGTCGGGGGG AAATGTTCCA CCTGCTAGGT GTCAGGCAGA
231401 TTGGAGAGAA GGGCATCGCA GATATGGAAG TCTGATTTCC TTCCTGTGTG
231451 TTCAGAGTTT TTTCACTTTT CTGTAGCCCC AGGAACTCTC TTCTTCAAAT
231501 TTGACTCTCA GATATTTCTG GTGATAATCT AGGCACTGTA TATTCGGTTT
231551 TGGTTTTCTG TGCAGGGGAT TGAAGCCAAC TTGCTTTCTT GCTGCCATTT
231601 TGAAACTGGA AAATGTCTGC AGTGAGACAT TTAAAGGAGT TGTACCTAAC
231651 AGCCTAAATG GGCTGGAAAT GTTTATCTTA TTATCAACAA CATAGACAAA
231701 ATATGGCAAT GGATGTGCTC AGTTAGGGAG GGCAGGAAAA CAAGAAGGCC
231751 TAAGACTCAA CATATAAGTT GGCAAACTGT AAACATTTAG GAAGAAGGAG
231801 ACTAGAAAGA GGAAGTTAAT AAAGGAGAGA AAATGATAGT GTAGGAAGTA
231851 TGAAGGGAGA AAAACAGTTT AAACATGTTC AGCTACATAG AATGCTGCAA
231901 AAAATGTGAG TTAAAATGAA ATTTGAGAGT GGTTCATCGG AATTTCAATT
231951 TATAGAATTC AGATGACTTT AAAATATAAT TTGGAGAGTG GTAGACACAA
232001 GCCTGTTGGA GTAGATTGAA GAATGAATGG GAAATGAAGA AGTAAATTAG
232051 CATCCATAGA AAAATTATGT AGAAGAGATA TAGTTAGTTG GAATAGATTA
232101 TGAGAGTCAT GGAACTTTTT TTTTTAATTG GGAGAAAGTG GAATATTATG
232151 AGTATATGTA GTTTTGTTTT ATTTTTAAAA TATCTTAATT TGGGGCATTT
232201 TACTTTTAGC TTGTAATTTC AAATATTCTG GAGAAATAAG ATGGTTTTTC
232251 AATGAATGTT TATGTAAAAT TTACATGTAT TCGGCAGTAA AGAGTTTGAA
232301 AACTGACAAT TGTTTGCCAC AAGTTTACAG CTTTTAATCC TGATGTTTTG
232351 TTACAGCAAG GGGACACTTC GAAGTAAGTT GTTAGGCAGT AAGTCCTTGT
232401 AATATAATTG GACACTGAGC AAATTGCAGT CTCAAAGCCA GCCCTCGTAA
232451 CCTTTATACT ACTAAGTTCA ATAAAAGTGC AGAAGACAAT GAAGAAGAAA
232501 CATGACTCAG AACTGAGAAA AATAACTGAA CAACTTAAAA CTGGACCTAT
232551 CATCCTGTTG TTTGAGACAT ACTATTGACT CCAGTAAGAA AACTGGTAGT
232601 TAAATTGAGT GAGAATCATA CCTGCTAATT ATAATAATGA TAATTATTAA
232651 TGATAAAATA ATGATTATTA TAATGATTAA TTATAATAAT GATAGTAATT
232701 TTGCTATTTA TTACAAATAC TTATATTTAT CAGCACTCAA TTATTGATGT
232751 CCACTTGGAA TCCTGGATTT AAGCATTCTT AACTGTTATT GCCTTTATTT
232801 TAAATAAATT TTAGATACTT TCCCTGTGTG TCTTAAGTCT CAAGTATGGA
232851 GAGACACTGA AATATATTCA GCATAAAAGA GTTAGTATTA TAAAATGGGT
232901 TTTCTGAGAA GGACTTTGAA TTAATATCCT AAATATAGAT CATGTTTCAT
232951 AACATAAAAC AACTTCATTA TATCTGAGAT TTCATATCAA AATCGGTTTT
233001 AAAAGTGAGA AACAAACAAA AGATAATAGA TCTTTATTAA GGTGTGTAAG
233051 CCATTTTCAA TTTATCATGG CCTTTGGTCT TAAGGATAGA AAAGCTTATT
233101 ATGAATTCTT CATGCTGTGG GAACTTGAAT TCCTTGGAGT GTTTTCTATA
233151 TTATTATTTC AACTCTCTTT CTCTGATCAA TCCAAATTGA TTTTAACATA
233201 GCTATAATGA TCCAAGCATT CATATTCTCC CTAGAGATGA TTCCTGAAAT
233251 AAAATAGTTT TATTCTTTGG CTATGTCAAA TTCTTCAGAG ATAATTTATT
233301 TCATAATCTG CAACAGCAAA GCAATGATGC AGTTGTTTAC CATGGAGTGA
233351 GGAAATTAAC CATTTGCCCT CTTCTTTTAC TATGTATGCC CATAGATTCA
233401 AAATTTTACA TATCAGTGGT AAAAATATTG TTAATTCTGA TGTTTAGAAT
233451 TTAATACTGA CACTTTTAAA GGGAATGTAA CACCAAAGGA CCTATTTACT
233501 CAAAAATTAT AGGAATCTTT ACCCTTATCC AGACAATCTT TTTCATTTAT
233551 TTTCTTCCTC CCTAGGTACT TATTTCTACT TTTGCTTGTT TATAAAAGTT
233601 TGAGATGAAT TAGTTTGCTT GTTTATAAAA GTTTGAGATG AATTAGCGTA
233651 CTGTTTGTAG TTTTTGTTTT TCTTTTGTTT TCTTTCCTCT GTACTAACAG
233701 TCCTAGTCAA AAACAACGAA ATCAATTATT CCAACTCTGT GGGGTCAGTT
233751 TTCTCAGTCT TCCTGTGCAT TCTCACAGCA TTACAGATAC ACCTTTTTTT
233801 AGAGCATTTA TCCCCTACTT TCATATGTAA TTGCCACTTG ACCATTTATT
233851 TATCCCTTGA AATCAGATAT CTTTCCTGGT TTTGCCAGTC CTTGTCCCTC
233901 TGATTTAAAG CCTGGAGTGT ATAGATGGAA CTGAAAATTT GGGGTCTATT
233951 GGACATTATT CCTGGAAGCA CTGACTGCTG TCTTGTAATG CTGTAAGGTG
234001 AATTGTGTCA TTTAGGAGAA TTTTGCCCTG TTATAACTCA GATACAAACC
234051 TCCTATGAAA GGGTGTCCTT TCTATGACTG CCTGCTCCAA AATCCACATA
234101 TTTATGTTTG ACTGTATTTC AATCCAGATG TTTGCCTTTT TAATTACTGA
234151 GTTGGTACCT ATACCAACCT GTAGTCTATT CTCACATCGC TATTAAAAGA
234201 CTACCTGAGA CTGGGTAATT TATAAAGAAA AGAGGGTTAA TTTACTCACA
234251 CTTCCTCAGG AAGCATAGCT GGGAGGCCTT AGGAAACGTA CAGTCATGGC
234301 AGAAGGTGAA GGGGAAGCAG GAAAGTCTTA TATGGCCAGA GAAAAAGGGA
234351 GAGAGAGTGA AGGGAGAGGG CTACACACTT TTAAACAACC GGATCTCCTG
234401 AGAACTCACT CACTATCATG CGAACAGCAA GGGGAAAATC CTCCCCAGTG
234451 ATCTAATCAC CTCCCCTTAG GCCCCTCCTC CAACACTACA AATTACAATT
234501 CAACATAAGA TTTGGGTAGG GACACAAATC CAAACCATGT CAGTACCTGA
234551 TACCTCAGTG AGACAAACCT TAATGGCCTT GGTCCTAGAG ATATGTCATA

FIGURE 3QQQ

234601 GTTGTCCAGG GTATAATATC AAAGATCTGG ATCCCATTCC TGAGGTAGTG
234651 TGTGATAATG TTTGCATATT TGTCTCCGCC CAAATCTTAT GTTGAATTGT
234701 AATCCTCAGT GCTAGAACTG GGGCCTGGTA GGAGGTGATT GGGTCCTGGG
234751 GGTGGATCCC TTATTAATGG CTTAATGCCG ACTTCATGAT AGTTCTTAGG
234801 AGATCTGGTC GTTTAAAAGT ATGTGGCACC CTCTCCCACT CGTGCTCTCT
234851 CCCTTTTTCC TGCTTTTGCT GTTACGTGCC TGCTTCCCCT GCACCTTCCA
234901 CTATGATTTT AAGCTTCCAG AGGCCTCATC AGAAGCTGAG CAGATGCCCA
234951 GGCTCATGCT TCCTGTACAG CCTGCAGAAC TGTTAGCCAA TTAAATTTAT
235001 TTTCTTTATA AATTACCCAG TCTCAGGTAT TTCTTTCTAG CAATGCAAAA
235051 ATGCCCTCAT ACAGTGTGGT TCTTATCTCA GCCCAAATTA TTGAAATTTT
235101 GAGCACCTAA CTCTTTGAAA AGGATTGTAC CTATTGCTAA TATTTGTTAC
235151 ACATCTCTAT GTCTCAGGAC TCTCTTAGGA CTCAATGCTC GGTGCTCGCC
235201 TCCCTGTAGA TCTAGCCGTG GTTCCAACCA TTAGAGAACT CCCCTGCTTT
235251 CGCTATAGCA GGCAAGGTTA CTCAGCAGGA GGGGCTGTGG ACTTTTTGAA
235301 TCTCTCACTA GGCTATGAGT AGAAGAGCAT ACACTTAGCT CCATCCATAT
235351 CAGAGCAAGA AGATCAGACA TACTGCCCCA TGTATAAACA GTTCAAAATA
235401 AAATCTTGAC CACCACCTAA CCACTCACAT TCTCTGCAGC AGGCAGTCTA
235451 GAACCTGTTG TGGTGACTTG GCCCAGCACT GTAGCTCCCT GCCAGCTTGA
235501 TCTCATCAGG TGAGCCCTTA GAGCAGACTA GGTAGCAGAA AGGTAGCCTT
235551 AATAACAGAG TGGCAAAGTG AAGCAACTGT CTTATTGCAA ACCACTGACT
235601 CATATAAGTA ATTCTCTGAT CTTGTATTTT ATCTTTTTTG TTTAATCCTA
235651 TCATTCCTTT TTTCCCCCAG GAAAGAAAGT CTGAACTTTA ATGCTTTGTT
235701 TTTGAAATCC CTAAATATGT GGAAATTGAC TCAGCGGTCT TCCCTTCTGT
235751 ATTTCCTGAA CCAAAGGAAA GACAGCTAAG GCCTCAGTCC TAATATAGGA
235801 CCAGAGAGAA GATGTAATAT CTCAGTGGTA GCTCCACACA CAGACCAACT
235851 CTCCCTTGAT AGGGACAGGT AGTCAGCTGT ATATATCCAA ACCTGAGCTG
235901 CCCATTCTCT CTTTCTGGAA CTTTATAAGG CCACATGTCC CAGAAAGGTA
235951 CCTTAATCCT CTGAGCAGGA ATATAATGGA CACTTGGAAA ACATCAGTGG
236001 GTCACTTCAT GTATCAGGAA CCCTGGAAAA CCTTGCCAAG AATAAGGGCA
236051 TTTTCTATGC TGATGCTCTT TAGGAAATAC TAAGAGAACA CTAACGGATC
236101 TTGTACCAAA CTGCAGAAGC AGCAGTGTTG TGGACCTTTT CAAAGCAGGC
236151 TCCACAGCTG GATCACTTCA CTTCCACCCT CCCACCCTGA GTGAGCTGCG
236201 TAATCTTTAG TTAGGGCTTT TGCTTGTCTG ATTCCTCAGT GATCATTGCC
236251 TTTTCTAATA CTAGCCAAGA TAGGAAGCAT CTAAAATTTA GCAAGTATAA
236301 AAACCAAAAT ATTTATTTTA AGATCTATAG AGATGTTTCC CAGTCTTTTG
236351 AATATATTGT CATACAAAGA AATATATCTG TTCAGCACAC TGAGGTCCTA
236401 ATGCCTCTAT TTATTGCTAC AAGTGATTGA CCCCCAGGGC TGCCCCAGAC
236451 CCTGCCCAAA AGCCCTGATG GCTGAAGGAA TTTGTCCACA CTGGTTGGAA
236501 ATCCCAAATA TATGCAGAAC TAAAATGTTT AGCAGGGCAC TCATGGTTCT
236551 TCATAGACTA TTTTCCTACA TCATCTCTCT CTATTTCTCC AATGTATGGC
236601 CTTTCAGCCA ATGGATGATC TCCATACAGT CAGTAGAGTT TTATCCTTCA
236651 TACATGTACA GATGATGCTT TCCAAACCTA GAATACCTGC TCAGGCTTTC
236701 TACATGTGAC AAAGTCCTTT TTATGTTTTA GGATTCAGCC AAATATTATA
236751 ATCTATTTTT GCAGAAAGAT TTAGGCATTT TTTTCTTCTG TGTTTCTTTA
236801 GCATCTTGTT TATAACACAG CTTTATAATA TTTCACATTG GATGTAATTA
236851 TTTCTGCATT AATCAAACAC TTCAAGCAAG AAAATGAAAT TAACTTTTGA
236901 CTAATCAACC TGTATATACC AGGTATGATG CTTTGTGCTT TTACAGACAT
236951 GATTGCCTTT AACCCTCTAT GTTGTGTAAG GCAGGAAGGC TCAAAACCAT
237001 TTTTGCATAA GAAAATGATA GTTAGAATTA TCCTACAACT TTCTTAAGGT
237051 GAAACATCTG ATAAGTGATG AGGAATGAAT TGCTATTAAT GTTCTCAGAT
237101 TTTACCAACC ATGTCCTTCT CATTTGCCTG GTTCTTTAAA ACCTGGCCTA
237151 ACATAAAGAT ACCCATCAAA ATGTTTAACT AATAAAAGAG GGAAGGAACA
237201 AAATAACAAA GGGAAGAAAG GAAACATTGA AGGAGAGGAT AAAAAATAAA
237251 GGGATCAATT AACCAAACAA CTATGTTCTA GGAAAAAAAA AAATCTCTGG
237301 ATTTGTATGC GGGACACCGA CTCAATTGGC TTCTGACTTT CAAATAATAA
237351 TTGAACTGTA CATTAGAATA CAGAGATATA GTAAATGGAA TGAAAAAAGT
237401 GGAGGTAAAC TATAAAAACT TGGTCACCAA CTTTTTTTAA AACAAAGTAT
237451 ATGCATTAAG ATAAATACAA AGAACTTTGT TTAACTCAAA TAAAAATCTG
237501 TCTTTAGAAA GTCTAAGGAA AAGAACTCTT CTCATATGGA TAAATTAGTA
237551 GAAGAAAACT TTATTGTGAA GTATTATATC AATTTGAATG TTTAAATTCA
237601 AATATGTAGT TATTGATTTA TTTTAATATC TGGTATTCTA TGAGACACTT
237651 TGAACTTAGT CTGTAGTTAA ATATGGATGC AAATATTTTA ATAAACTGTG
237701 CCGTTTTTAA GACTTTAAGT GATATTTGGT GATCTAAAAT ATCATCTAGT
237751 AAAGATAAAA TTCAGTAATG TATAGTTAAA AAACATAGTT TCTCTTTCTC
237801 AAATCTAGCA TGTTAAAGAA AATATCTGAT ACTGGTATTT TGTATCATTA
237851 TATAGTTCAG TCAAGATTAT CTCCCTGACA GATGGCTACA TGCAAAGCTA
237901 ATTGCAATAT GATTAAGAAG GATCGGTATG TCACAAAATG ATAAAATTGC
237951 CGTAAATAGC ATAGAGCAAA AATCACGTAA TCAACACTTA TCTGACATAG

FIGURE 3RRR

```
238001 TCTTTTTATG AAGCGTACAA ATCTCTAAAC TGCTTTACTC ATTTCATTTT
238051 TTTTCTTTCC TTCCTGGGAA AGAAAGAAAA TTGTTCTTTC TTTCAATAGA
238101 AAGAAAGGTT GATTGTTCCT TTTCTAAGTA AAAAGAAAGC TAGTTAAATA
238151 CTCAAAAGAA ATCATCATAA GTTACACAAA AATAGATAAA TCTCAGAAAC
238201 TGAAATAAGT AATTTCATTG CTTTGGAAAT TTTATAAAAT ATAGTGAAAA
238251 CTACCAATTC CTCATAGTCC CGTTACACAG AGACAACATA CTTTGTACGT
238301 TTTTTGAAAA GTAGTGATTT TAAAATGATT ATGTGTTTGT CAGCAATGTT
238351 TGACCACTGC CCTTCTTGAA ATGGTGGGTA CATATGTAGG TATGTGGGTA
238401 CATATCATGG TGAGATTTTG TCGCCATTCT TTTTTATTTA TTTCATTTTC
238451 ACAATATAAT AAGAAGCAAA GTAACCAGCT GAGAGTGTTG GAAGGTGGAA
238501 ATATTGAAGA TTTGAAATCA TAGTGTAAAA CAGATAGCCA GGAGTCTGGA
238551 AATGAATGTT CTAGGGAGGT ATTAAAGTCC TCAAGACACA GAAAATCTCT
238601 ATTTTATGCA AATTCCTCTA TTGATTAGAA AAAGAGAGAT TCTTCCTAAC
238651 TTATACAGCT AATAAGCTTA ACACCTACTT TACACAAGGG TAGTATAAAA
238701 AGGACAAATC AAACCATTTT TATATTTGAA CAAGGACATC ATAGTCCTAA
238751 AGAAAACAGA AGCTTAAGCA CAATGATGTG CAAAAACGAA TGCAGCATGA
238801 CCTGGTTGGA TTTATCCCAT GGATTGAAGG ATATTTTAAC ATAAAATCTT
238851 TTTATATAAT TCATCACCTT AGCCAATTAA AGGAGAAATA TGATCATTTC
238901 AATAGATGCA GAAAATTCCT TTGATAGATT TTAACACCTA CCCATGGTAA
238951 AAACTGTTGG CAAAGTAAAA ATAGAACACA ATGTCCTTAA AACAGTAAAG
239001 GATATATTCA AAAAACATAC TTCATTGTGA AAGTTTAGAA GAATTGAAAG
239051 ACATGACAAG ATGCCCACTA CCACTACTTT GTTCAACGAT TTGTTTGATG
239101 CACTCATTCT ACAGATGGAA AACATTTAAG AATGGAAAGG AAATAAAATT
239151 GTTATTTAGA GATATTATTA TCTGTGTAGA AAATCCAAGA TAAAGAATAA
239201 GCTATCCAAA TCAATAATAG AATTCAGCAT ATCACTGAAC ACAACCAATT
239251 TACAAAAGCC AGTAGTAATT CTATCTCCCA ACAAGAAACA ATTGAAAATT
239301 ATAATTGAAA GAAAATTCCA TTTAATAATA TCATTAAAAA GCATAGGGGC
239351 CTAGGAAAAA TGTCCTGCAA AAATTTTAGA AAATAATCAC AAAACTTTAT
239401 TAAAGATCAA AAACTAAAAC TTAAATTACC ATTTACATAG ATGAAAAACT
239451 TCAATACTAA AATGGATGAA TGTATATCAT TAATAAACTA ATACAAGAAT
239501 TGTCTAAATG ACTAATTCAG TTTAAAATTT TTATTGATAA TGTGTTTTTC
239551 TCAGTCTTGT TTAGGAAATC CATATGTACC CTATCATCAT AGATAGTATA
239601 TTCTTTTAAA TATTTTTAAG TATTTGATTT TTATATTCTC TTTTTATCAA
239651 CCTGGATTTG AATTTGTATA TGGTATAATG ATAGGGTGTA TATGGATTTC
239701 TGAAACCTGG CAGGATAAGC TATTAAAAAA TACTAAACAT ATTGATTTAT
239751 TTAATAATAA ATTTCTGTAA GATATAAGAA ACCAGGGGCC GGGCACAGTG
239801 GCTCATGCCT GTAATCCCAG CACTTTGGGA GGCCAAGGCG GGTGGATCAT
239851 GAGGTCAGGA GATCAAGACC ATCCTGGCTA ACATGGTGAA ACCCCGTCTC
239901 TACTAAAAAT ACAAAAAATT AGCTGGGCGT GGTGGTGGGC ACCTGTGGTC
239951 CCACCTACTA GGGAGGCTGA GGCAGGATAA TGGCATGAAC CCAGGAGGTG
240001 GAGCTTGCAG TGAGCAGAGA TCGCACCACT GCACTCCAGC CTGGGCAACA
240051 GAGTGAGACT CTGTCTCAAA AAAAAAAAAA AAAAAAAAAG AAACCAGAAG
240101 AGAAGTGGAA ATACTATCTA CATCTTATAT AAGGGATGGG TAGTTTATAT
240151 TATGTGCCTG AAGTCTGGAA ATAGGAAAAC TTTGTACAGA TTATCTTTTA
240201 AAAATTAAAT CTGCAGTGAA ATTTGCTTTG AAATCTAATA TTTGTAAAAT
240251 ATTAATATTT GTAAAATAGT AGTACAGAGT ACTAAATAAG TGGATTGTAT
240301 AACTTCAGTT GGAATGAAAG AAGCAATGAG CATTGGAGTA ATAATTGCAC
240351 TAAAAACCAT ATCAAGACAT GGGTTATTTT CCTTCTGAAG GAAATACTGG
240401 AGAAATGCTG TAGTTGATGT CGATTTGAGC AAGACATTTG GCAGTCATTC
240451 ACAATGGCAT TATTGACAAA TGAAGTTCCA GGATTGTTCA ATAATGGATC
240501 AATGTCTACT TTAATAGAAT TCTCAAATAT ATATTATATA GCTCTACTCA
240551 TAGAAATATC ATGTTTTAGT TTGATCAATA CAGTTGATAA ACATATAAAA
240601 CAATTTTATT AAAATCAAGA AGAATTCAAA TATGGAACAT ATAAATAATT
240651 CAATAAAACA AACATAACAT CTGCCCAAGA TGAAGATTTA TTTTGTTGCT
240701 TTAGATAAAG TTCTTGAAAA CTAATAGAAA AGCTATGACA AGCATATCAA
240751 ATCATGCTAA GGCTGAATCT TTTGAGAGAA TTATTTTTGA CTGGGAGAAT
240801 AATTCACTAA GAATATAGTA GTTGGGCAGT GGCTTGTTGG AAGGGTAGGG
240851 TTTAGTAAAC GGAGTGGAGT GAGAATGGTT GCAGGTGAAG ACACTGCATG
240901 TGAACAAAAG GCATAGAGGT GAGAAATTGA GATACATCGT CACAAATGGC
240951 TTAAATGTGA CATCTAGGGA TCAAATTAAA ATTATCTTGA ATGCCTTGTT
241001 ACAGATTTGG GGCTTCATTT ATTAAACAAT GGAATTGAAT GTAATTGAAC
241051 ATAAAGATTA TTCTTGCAGG AGAATGTATG ATGTATTAGA TTAGTGAGAG
241101 ACATTGTAAG GAAGACAATA ATTCTAACAA AATAGAATTT CTTTCTGAGC
241151 TGTGACATTA GTGATGGGTG GGATTGATGT GAGAAAAACC ACAGGGGTCA
241201 TTAGATCTGT AATATTTGTA CATGGAAAAA TTATTAATTT AACCAATATC
241251 CATTGATTGG CAAGTAATGG AGATAAAATA GTGAACAAAA CTGTGCAAAA
241301 TCCCTGCTTT TAAAGACCTT ATTTAAATGA GGAGGAGAGA AAGATAATTA
241351 ACAAAACCCA CAAATACAAC TTATAATACA TTAAAAAACA AATGCTGCAG
```

FIGURE 3SSS

241401 AAAAACGTGA AGCAATGAAG AGAGAATAGG AAGTGTGAGA TTTGGGGAGC
241451 AGGGGGATGT GCAGTTTTAT GTAAACTGAT CAGAAAAGGT CTCATTCTGA
241501 AGATGATATT TAAGTAAAGA CACGAAGGAG GTGAGGGAGT CCCCTGGGAT
241551 ATTTTGGAAA TAGTCTTTCT TGTTTGAAGG AATGGCAAGA ACAAATGTCC
241601 TGAGACAGAA GCATATCGGA AGAACATCAG GGCCAGTGGG GCTTGGGGGA
241651 TTGAGTGAGT GGGCGACAAG GTCAGAGAGG TACTGGAGTG CACCTCCTAT
241701 GTAAGGCCAG TGAAATGTAA AGGCTTTGGT TTTTACTTCA TGGCACATAA
241751 GATACATTGG AGAAATTTGA TCAGATAAGT GTTATGGTCT GACTTGTTTG
241801 TTAACAGCAT CTCTCTGGCT ACTGTTTTGA AAATAGATTG AATGGAACAA
241851 AGAGGAAGCA GTGAGAACAG TTAGGACTTT ACTAGAAGAA GCACCTGAGA
241901 ACAGTGAACG TTATCCTGGC AATTTAATTT GGAACATGTA TGACTGTTAA
241951 TTTGGTGAAT CCCATAGAAA TATTAGGAAG AATAACAGAT TTGTGGTAAA
242001 GATAATAATG CTGGTGTTGT ATCATGTTGA GTTGTAAGTG CAGATAGCGC
242051 AGATAGAGCT TTCGGGTGGA TTTAGTAATC TCGTTTTACA AGTCATCTTC
242101 ACCCAGAGCT TATTGATCAG TACACAAATT ATGTGGAAAT GTAAGTCTTA
242151 GTGAATTTTG GGTCACCATA AAGGAATGAA TACCTGAGAC TGGGTAATTT
242201 ACAAAGAAAA AAATGGTTTA TTTGGCTCAG GATTCTGATG GCTAGGAATT
242251 TCAAGACTGG GCATCTGGTG AGGGCCTCAG GCTATTTCCA CTCCTGATGC
242301 AAGGCACAGA GGGCCTGGGG AGATGCTAGG TTCTTTTTAA CAACCAGATC
242351 TTCGGAGAAC TGATAGAATG AGAACTCACT CACCCTTGAG GGGAGATATT
242401 ATTCTGTTCA TGAGGGATGT ACCTTCTTGG CTCAAATACC TTCCATTAGG
242451 CCCACCACCA GCATTGGGGA TCAAATTTCA ACATGAGGTT TGACAGAGAG
242501 AAACATCCAA ACTATAGCAA TGTGTTTGTG AAAAACTGTT GAAACTTCAA
242551 AGAAAAGAGT GTTAACGAGT AAGAAAAATA ACTGTTTTTA AACCATTTGA
242601 AAGCTATCAG ACAGAAGACA AGTTAAATAT TTTCTTCTGC TAATCTCTCT
242651 TTCATTGACA AGTGATCTGA GGCTCTGGAC TCAGACCAAC GTGATGTGGT
242701 ATTCAGATAG CCTTGGGCAG GTTAGGATCA CAGCGTCTCT GAAAAGTTCA
242751 TGGTGGGAAC CCTCCAAAAA AGCATTAAAT CCAAATGAGA TCAGGAAAAG
242801 AGAGACACTC TGGATACACA GCAAATTGTG CCCAAGAAGC CTTGACTAGG
242851 AAGAAGATTT CACGAAAGAG GTAAGAAGCA GACATGCCAG AAGTAATTCA
242901 TCTAACAATT AGCAGACAGA CTCAGTAGTG GCTTTTGGTA GACTCGAGCT
242951 ACATGTGACT CGGGCTGGGA TGTGTGTCAG AAGGTTAAAA GGCACAGCCA
243001 GTAAGTAAGC TTAGAAGAGA ATGTGAAAGA TAAAATTTCA GTTGTTTTTC
243051 AAAAATATGT TTCCCATAAA TAGACTGTGT TGCTTTGAGA GCATTAAAAA
243101 TACTGATAAA CTAAAATGGA GGGCTGCCTA TCAGAAATAA TTTTAAATGG
243151 GTATTTCAAC AGAGGTAAGG AAATAGAGTT CATGATTTCT ATGTTATTCT
243201 CCAATTCTAA AAATACGTGA CTGGGAGACT TCTGTATCTT ATATTGAGCA
243251 CAAAGATTGC TTGTGATAGC TGCTGCCTTT TATGATTATT TATTTGTTTA
243301 TTTTTTACTT TTTCATAGAC TTAAACAGGA GAAACTAAAT AATTGCTGTT
243351 CTTTTGTTGA GTACTACCTA GGTAGAGAAG TTTACCATGA AATTATAAAA
243401 TTCTATATTT CAGGCTGATT ATTTAGGAAT AAAGTAGAGA TAAAAATGTG
243451 ATTCTCAGCA TAACCTTGGA ATTCACTCAC TAAATTTATA TACTAATATC
243501 GAACTTGAAT TTACTTAGTC CTGGTATGAA GAATTCTTTT GAATGAGGCT
243551 TCTATTGAAT GAAAATATGG ATGTTGTCAG AAAGAATAAG TTTACCCAGG
243601 AAACATGTCC AATGATAATA TTTTAGACAG GCTTGTCAGG ACCCTTAGAG
243651 AATTGTGAAA ATTGAGAATG GCAATACATA ATGGAGGCAA TCTATGAAAC
243701 AATTAATAAG CTATCCATCA CTCATTTGTT TAACACTAAA TAGTCTCAGT
243751 AGTTTCATCT GCTGACAAAA CATCTTGTAA ACAACCACTG GGACATTTAG
243801 GATTTGGAAA ATGTCACTGG AGAACTGCCT TTTTCTCTAA TAAATGGAGC
243851 AAAGAAATAC TTATTAAATC TCCTCCGTAA GGAGATATAG TATGTATGTT
243901 TATGTGTGGC CCAGAATTTG TGGTGCTTAA GACTTGACCC CTGCTGTCTA
243951 GGAAATGGCT GTTTTGTAGA GAAGGTAAAA ATATAAAAAA TAATTACAAA
244001 ACCAGGCACT ATATGCTCTG TGCCATATGA TATTCAGTGT TATGCAGAGT
244051 CTCATAGTCA TGTCACCTAC ATAGAATAAC CTGGAATACT TTTTAAAAAT
244101 ATCTCTTGAC TTGATTCAGT CCACATCCAT GGAACCAAAA ACTGTGTGGA
244151 AATTAGGAAT GTGTATTTTT AAAACTCATT TGATGTTAGA TATGTACCCC
244201 CAAAGTTACA TGATAAGTGT TGCAGTAGTT TTCAGGAGGA AGATTGCTTC
244251 TAGTTAATTC TGTGGTTCTC AATCTTGGCT TCACACAGGA ATTAGTTGGA
244301 AGGCTTCACT GATGTTTAGG TCTCACCCTC AGAGATTCTG ATATAATTGT
244351 TCCAGATTGC AGCCTGGACA CTGATTATTC ACAACCAAAC ATAGTAGATG
244401 TTATATTCCA AATGTTATAG TCTGTGTATA AGACCATTCA TGATATCATA
244451 CATCTAATAC TCGATCCGCT AGCCATATTG AACTACTTGA AGACTCCAAA
244501 GTCGTGATAA TGATGACAAT TAAAATAATA GTAATGTTTA ATATGTATTT
244551 CGTTATCATT ATGTGCCAAC TATAAATTTG TTTATCTTCA TGAAACTCCT
244601 TTGATATGAA TGCTATTATT ATTACCATTT TATAGATGAG GAACAGAGAC
244651 AAAGTGACTT GGCTATGTCT ACATGGTTAA TAGGTGACCA AACTGGGATT
244701 TGAACCCAAG CATTCTGGCT CTACAGTGCA CACTGTTACA TTATGCCACT
244751 CACGCATATA CTCTATTTCC CCCATGCCTG CCTCATATGA TTGAACTCTG

FIGURE 3TTT

244801 TCATATGTGT TTATATTGCC TTGAGATATC TTCCTCTAAC CTCCTGTATG
244851 ATGACTGTTT ACCCATTTTC AGTTCATAGT TTAATGTGAC TTCCCTACAG
244901 GAATTTTTCC CTACTTCCTA CTCTGAGGAG TGATGCTTCT GTTGCAGTTA
244951 GTTGCCAAAG ACTTTAATTT TTTTTTCTTT GTCTGTCCAC ATTACTGTGT
245001 GAGTTCCTTG AAGAAAGAGA CTATGCTACA TTTATTTTTG TAGCTCCCTT
245051 AACAATGTCT GCAACATAGT CGCCACTCAA TATTTGTTGA CTAAGTAAAT
245101 AATTTAATGG AGGAATGCAT CATTGAATGT ATGGGAAAGT AAAGGTGTGT
245151 TTTGGTCTTT TAAGTAAGTT AATTGAACTG GTTTATTAAG AAGTAAAGCC
245201 AAAAATATTT CAGAAGCCAT TACCAAGCTG CTTTAGTTCC TGACTGGGGT
245251 TTGGATTTCA TTTTCAGATA GTAGGGGATT ATTGAGGATT TTAAGTAAGG
245301 GAGTCAGATA ATATACCCTG TTTCTACCAA TAACACTTGA TAAACTCAGG
245351 GGACCAGCTA GGAAATCCTG TGAACAAGCC TTAAACATCC CAAGCCATCT
245401 TGGATACAAT GCCATCTCTA TCAGGGGAGG CCTACCTCCA TCTAACTAAA
245451 TACACATTGT CAACTATGGT GGTGGACAGA AATGAGCAAA ATGTGAGGGA
245501 TGAAGGAGTG GTGCTAAGCC CAGTTCCAAG AGGTGAGGTA TATATAAAAT
245551 TAGTTGCAAA TGGCCTGCAA AGCATAGCAT ATTATCTGGC CCTTTACAGA
245601 AGTGTGACTG ACTGGAAGTG TTAAAAGCAT AGGGATTAAT TAAGCGACTT
245651 ATATAGGATA TTACAATCTA TATGAAGTAA TGAAGGTATG AATGAGGTAA
245701 TAAAGGTATT TTATCATGGA GCCTTTTAAA ATTGAATCTA TCAAAGTTAA
245751 TGCCATCTCG GAATAAACGA CTAGGAGTAT AGAGCATAAA GGGTGAAGGG
245801 TTATAGTAAG TAAGGGTAGA GGTTCTGTAG AGAGTACTCA CAGGGTTAGT
245851 CTGGTCTAGA GAAGGACTAG TAAGTTCAAT TCGAGCAGAG CTGTGAGATC
245901 AGATGTAGTA CATGGGAACA TGTGCTGGTA CTGAGATAGA ACCAATAGAT
245951 GACCCAGAAT TGGAAAGAAT TAAAGGAAAG TATAGGAATT CCTCTTCTGA
246001 CCACAGTAGA CACTTAAAAA TGATTACTAA ATTAACTAGA CTGGAACTGA
246051 CAGAAGAATC AAGCGATCTT TAAATCCAGG TAAACTATAG AGAGTAAGGT
246101 CCTAAGAACC AAGAAATGTT ATGCAAGAAT GGGCACATCT CAAACAGCCT
246151 AGGTTCAGGG GAGTAACCTC AGTCAGCCTT AATATGAGCC ACTGAGTCCT
246201 ATACAACTTG CATTTGTAAG ACACTAAATG CACTTTCACA TGATATTTTA
246251 TTTATATTTC TTACAGAAAT CTGATAATGT AGTTTAAGCA GACATTATGC
246301 CTTCCATTTT ACATTTATCC GAATGAGGGA TCATGAGTAT CTTCTCAGAG
246351 GCAAATTTAC CTTATAGCTG AAAAAGCTTA ACCTTCAGAG TACCTCATTT
246401 TCATGTGTCT CTTTCAAAGC CCTGTATCTC TATCTTAGAG AAACGCTCAA
246451 ATTATATAAT TTCAGGACAA ACACAATCTT GATCTTCCCT TGTGTTTCAC
246501 CTAACCTAGA TGGCATTGGG TGGGTCTGTA ACATCAGAAC CAGGGTTCTT
246551 TCTGTTATAA CACAGTGTCC ACTGTCTGCC TTTGGCGTCA TTCATGGCTA
246601 GGTAGTAACC AACACCTAGG GGGCTTACTA CATATGAGAT GACAAAATTC
246651 AAAGCAGCCA GCAAGTGCAA AAAGCATGTT ACAAGGAAAG CAGCAGATTC
246701 TGACATAACT ATCTAACACA CACACACACA CACACACACA CACACACAAC
246751 AGATTAAGAA AACTACCTGA ATCCCTAAAA AGAGATAGTT TATCAAGATT
246801 TACAAATTTA ATATTTCTTT CGAATGATTT AGTACATGAA TGGCTAAAAA
246851 TAGGTTTCAT ATTTGCTCTG GTATTCACAA ACACCAGACT GCAATTCACA
246901 AACACCAGAC TGCAATTCAC AAACGTGATT GCTATGAGAC TACTGAAAAT
246951 GAATATTAGT TATTAGAGAA AAGAAGGTGG AGTTGTCACT TGTGAAGAAG
247001 GGGCATTCCT CTACTACTCC CATTTATTTT CCTCTTTAAA AGACTTTAAT
247051 AAGTGCATCA TTACAGAATG GCATAAAATA TGACAAAAAA ATCACTAAAC
247101 TGTGTAACTG CTTAAATAAG GAGAGGAATA AATGTCCACT TTCTAAGTCA
247151 TTATGTCATT ATACACTGAA ATGAGAAGAA AATCTTTGCA TTTAGTTTTG
247201 AAAAACATCT TGAATATAAC AATCAATAAT AAGAAAGAAA TATTTCTTAT
247251 AATTATTGCT TCAAAAAGGT ATGCTCAGAA AAATGAAATC CTTTTCTAAT
247301 TTTTACCTGA TACTAAATTT TATTTAGCCT GTTTTATATG TCAATTATGT
247351 ATTTCTGTAT GTATTTAAAG ATTCTAGGTT TCATTGTAAT GGAGTGATTA
247401 TCATGGGTAC TTTTTTTTTC TTTATAAACC TTTCCAAGGG TAATGATACC
247451 TTCACTTTCT TCCATTGCCC TCTCTACCAT TTAAAATTTT TGTTACTTTC
247501 TTAAAAATTT CCCCCCTTTG GGAAATAATG AAGATGATTC TGCTTAGCTG
247551 TGTAGACTCC TGATTCGTAG TAGTGGAATG GGAACTGGGC CAACACATTT
247601 AATTTGCATT TCTCCTAGAA AATGTTGCAG ACTAACTCTT TAAAAAGCAC
247651 CAAATCAGAG ATATATTCTA GGCAACTTGC ATCAGAATGG CCTGGGTTGC
247701 CTATTAAATA TGAAAGTTAC TGTGTTCTAG CCAAAAACCT ATTGAACCTG
247751 ACCCTCTGAG GATGTAGATT AGGGACATCT ATTTTTAACA AACAAACTTC
247801 CCAAGTGATT CTTATTCACA TTAAAGTCTG AGAACACAAG CTTATATATA
247851 GCCTACCTCA TTTAAGTCCT AGGAGTGTTG CAAATGTATT ATGATACAGT
247901 TGCAAAGAAT AAAAGAATGC CCCTCATCCA TAGGGGGAAC TTGGGAAATC
247951 TTAGCTTAAA AACCTCTACC AATTAAGATT CATGAGTAGA AATGGTTTGT
248001 TTATAGAAAG ATTTTGCCTG GGTCATTAAT TTTTAGGAAG GCTTATAATC
248051 TTTTAGGAGT TAGATTCATA TGGAAATACA CAAGGGTTTG CAGACTGACA
248101 CTAAAATGAA CAGCTGAGTG CTTAAGTGTG GTAGGAGACA TTAAGAAAAC
248151 AGAATGCTTG TTAGATAAAA TGTAATGTTG AGGAACAACT GTCCTCCAGG

FIGURE 3UUU

248201 TATCTATTTC CTTATAAAAC ACTTGCAAAT GATTTTTCTA ATAGCAAATC
248251 ATGTATACAG TTTTTCAAGA CTATAAGTAT ATTAAATAGC ATTTTCATAT
248301 TTTTCCTTTG GCAGCACTCC TTTGATTTCT TTATTTTTAA GTAAAAATAA
248351 TGTATTTCCT AGGGGATGAC AATAATGAAA AGCTTAGTAC CTAAAAAATA
248401 TAGCAAAGGG CAAGCATAGG CACTTTAGAA ACTCAATTTT GCATTTTTAA
248451 CTTGGGAAGA TTTTGATCTG ATGTAATATA AGTTGGTATT TTAATTTCCA
248501 AATGTATTTA ATTTTGTACA CTTAAAATAT ATTCTAAACT TACATATTCT
248551 ATACTTATGA TTTGCCTAAT ATTATTAAAA CTTTCTTCTG CAAAAGATGT
248601 TTAATATTAC TGTAACCAGA ATACCATCAT TCCAGTACCT TGATGATTTA
248651 GAGAAAATCG AGATTAATGC TTTACACAGA ATATTAGAAC ATGTTATTCA
248701 TCTTGTGACA GCTGATATTA TTGCTGGAGT AGACAATACA GCATCGCAAA
248751 CCTACCTTAC GTCTATTGGT GCTACTATAT AATCTACTGT GTCTGAAAGT
248801 CACAATTTAC ACTTGCTATG CGAACATACT TATTCATACT GCCCCCTTCG
248851 CTCTCAAGTA TCCTGGTTTA GATAAATTAT ATGCTCACCC TAAATTTGAC
248901 ATCCTTACAT ACTTGGAATT ACAAGTCTCT TCTCCTATCT AAACATTTTC
248951 ACAAATCTGT TCTTTTATCA GCATCCCATA ATAGGTAGCA AAAGCACTGT
249001 CACAAGAGAA GGGAGGAAAT TGGTCTTCTA GTTTGACCTT CTCCCTCAGT
249051 TTGGAAATGT TTGCACTCAC AAGTCACATT ACCTCTTGTT GGCTCTTGGC
249101 CTCATGTACT GTATAACGCC AGAAGTAGAA AAATGTCCAG ATTCATCTGT
249151 GCTCCTGGTG TCTTGGTAAA GGACGTATTG CTTGGATCTG GACCCAGACT
249201 TCACAGAGCC CCTTATCAGT AGTGCATATG AATATAAAAT AGTAGAAGTG
249251 TTTTAACATA GTGGTTGAGA TCTTAGCCTC TGGAGTTAAA CAGACCTGGG
249301 TTTGCAACGC GGCATCTTCA TTTAATCTTC CATTTCTCTG TAAAGTGGGA
249351 ATATTAAAAG TCCTTTCTTC ATTTCTCATA GGTCTGTTGT GAGGTATTAT
249401 TGAGATAGGA AATTTTTCAT AATACATTAC ACACAGTACC TATTATTTTG
249451 ACTGCTACTG CCACCACCAC AATTATTGCT ACCAAGACTC TTGCTCCTTC
249501 TAAATAAATT ATACACTTCC CATAAGAAAA TTTGAGAAAT AGTTTAAGTT
249551 TAAAAGGATA TATGTGATCA TTATTCCTAT CTGTTGCCTT GTTCCAGATA
249601 AATTGCAGAG TTACATAATC CATTCTTGCA TTCAGTCAGC AAATACATAC
249651 TGGCTAGGTC AAGAAAGAAT ATAAAGAAAA GAATAGTGAC ATGTGTGTGA
249701 TTTTACTTTG GTTGCCGGGG ATATTTCATC ACAATTAATT TTAACCATCA
249751 TCCCACACAC TTTCCCTATA AATATCAATA TTTAAAATTG ATAACTTTGA
249801 TAACTAAACC TTGTTCCATC CTGCCAAATG GAGGAGATAT TAGGAAAAAT
249851 TCTTTGTATC AGCTATACAC TGCTGGCCTC TTCCAGGCTT ACTCATGTAG
249901 CTGCATACAG CACACAGGTT GCCTGGGGAT TTGGCTTAGC TGAGGATGCT
249951 ATGATGGTTA AGTCTCCCTC TTCATGTGGT CTTCTGTCCT CAAAAGAGAC
250001 TTTGCTTGGT GATAGCAATG TTTCAAGAGG GCAAGCCCCA GTATGAAAGG
250051 ACAGTCAAAC CTCTGCTTGG GTCACGTTTG ATGATGTCAC ATCAGCCAAA
250101 GCAAATCACG TGACCAAGGC CATAGTCATT GTGTGAGGCG AATACACAGA
250151 GTAAAAGTAT CAGGAGAGTT GTCTTATTGA GAGACATCAA TAAATGCACC
250201 TACCACAACT ATCATAATCA CAGTTATTAT TTTTGATAGA AAGGATATAC
250251 TCATAATATG TATATAAGAG TGGGATATTT TGACCAGGCT TTATAGCTGA
250301 GCTAGATATT AATTCTCCTT CTACTTCTGC ATGAAAGAAC TTCCTGTGTT
250351 ATTTCTAAGA ACAGAGGGGA GAATTGAGCA TTCTTGTAAT GGAGCTTTAA
250401 TTTAGACCCT TATCCTTTAT CATGGGCAGG CACTAAAGTT TCCATCTCTG
250451 TACAGAGAGT AAGATGAATC ATCTGCTTTT ATTCTGTTCT TGGGCCTATT
250501 ATATGTTGCA TTCTCATTTT TTTCCTAAAT AATAATATTG ACTTTTATAT
250551 GGATTTCCTA TTTTAATTTA AACAACATTT TCACCACAGT TTTTAGTTGT
250601 AAAAAGTGAA AATAATTTAT AGTATTTAAG ACCATTGCAG AGAGAAATAG
250651 GTAATCAATT TAACTATGTC ATTATAAAAT TTAATAATCT GTATTTGTTT
250701 TTATAAACAT TACCACATGT TTACATATAC AAAGGTATGC ATGTTTATAT
250751 ATAAATATGT GAAAAAAATA TATATATAAA GCCAACCAGT GCTTTTTACC
250801 TGAAACCTAG AGTAGCTAGT ATCATCTAAG AGTAAGGAGT TTTTTTTTTG
250851 TTGTTGTTGT TGTTGTTGAG ACAAGTTTTG CTGTTGTTAC CCAGGCTGAA
250901 GTACAACGGC GTGATCTCAG CCCACTGCAA CCTCTGCCTC CCAGGTTCAA
250951 GAGATTCTCC TGCCTCAGAC TCTCAAGTAT CTGGGACTAC AGGCAGGCAC
251001 CACCCTCCGG CCCCAGCTAA TTTTTGTATT TTTGGTGGAG ACGGGGTTTC
251051 ACCATGTTGG CCAGGCTGGT CTTCAACTCC TGACCTCAGG TGATCCACCC
251101 ACCTTGGCCT CCCAAAGTGC TGGGATTACA GGTGTGAGCC ACCATGCCCG
251151 GCCTGGAGTA AGGAGTTTTT AATCAAGTTC TTTTATTGTT ACTTTCAATA
251201 TAGGTATTCA AATGATTTTA ATTACTCAGG AGCTTAAATT CTCTTATTAA
251251 AGTGAATTTC TCCTTAATCA CTTTTTGCCT ACAACTGGAC TTTGAAAAAT
251301 ATATAAAGAT CCGTGAATCA ATTCCACTGA TTTAAAGGGT GTTCTAATAG
251351 AGGTAGCTTG AACAAGACTT CTTAGTGATT TATCTTATGT CAGTAAGATT
251401 GTTTTTATAT TTTATATGCA AAGTGATTTA TCAAAAACAC AAAAGACTCA
251451 GACAAATCCT GGAGGGAAAA TGTCTTTCTG ATCTCAGGTT AACCTCAAGA
251501 GCTTGGGTTA TTCATTCTAC AACTGGGGCA GCATGGAGGA GTGGGGGGAC
251551 GCAGATTATC TCTGCCTGAA CAGCGGAGTC TTTAGATCAA ACACCAAAAA

FIGURE 3VVV

251601 TAGGAGATGA GGAAAAAGAC AAGCCTTAAG TAAAATATAC AAAAGCAAAG
251651 CAGCTGGAGA ATAAGAAAAC TATTGTTTTC TTGGATGTAG GAGCAAAGAG
251701 AGGGACCCCA GAAGAGAGGA AAGCAAATAT ATGCCTCTTA GTATCTGATT
251751 TTCAGAGTCA TTGAACTAGG TCTCTGAGAA TCAAATTTTT CTTCTCAAAT
251801 GATTTTTCTT TGTAATAATA GCCTATGCAA AATAAAACCA GCTGCCTCAA
251851 AGGAAAACAC ACATCTTTCC TTGCATTCCA AATGCTTTGA TTGGAAAGGA
251901 AATCTCAGAC CCCTTAGGGC ATTCCTGTCT CTTGGGGAAG ATTATCATTT
251951 TACGATTTGA TAAGTGTAAC ACACATTGAA ATTCCTGCAA GATGTTTGAC
252001 TAGTATAGGA TTTCATATTT TCAGTCATTA GAATGAATAA ATTATTTCAG
252051 ATATATTATC ATCAAAGGTA TTGTAATGTG GGGACACAGG AAAAATTCAC
252101 TTTTCACCTA TGCATTCCTG AGAGCTAAAA AACAAATTAG ATCATCATAG
252151 ATCAGCTCAT ATTTTCACCC ACACAATTTT GTTGTTGTGA ATTTTATTTT
252201 TATTCCTGAT TTATTTTATT CCTGATCAAT TTAGCACCAG AGTCATCCTA
252251 GATACACNNN NNNNNNNNNN NNNNNNNNNN NNNNNNNNNN NNNNNNNNNN
252301 NNNNNNNNNN NNNNNNNNNN NNNNNNNNNN NNNNNNNNNN NNNNNNNNNN
252351 NNNNNNNNNN NNNNNNNNNN NNNNNNNNNN NNNNNNNNNN NNNNNNNNNN
252401 NNNNNNNNNN NNNNNNNNNN NNNNNNNNNN NNNNNNNNNN NNNNNNNNNN
252451 NNNNNNNNNN NNNNNNNNNN NNNNNNNNNN NNNNNNNNNN NNNNNNNNNN
252501 NNNNNNNNNN NNNNNNNNNN NNNNNNNNNN NNNNNNNNNN NNNNNNNNNN
252551 NNNNNNNNNN NNNNNNNNNN NNNNNNNNNN NNNNNNNNNN NNNNNNNNNN
252601 NNNNNNNNNN NNNNNNNNNN NNNNNNNNNN NNNNNNNNNN NNNNNNNNNN
252651 NNNNNNNNNN NNNNNNNNNN NNNNNNNNNN NNNNNNNNNN NNNNNNNNNN
252701 NNNNNNNNNN NNNNNNNNNN NNNNNNNNNN NNNNNNNNNN NNNNNNNNNN
252751 NNNNNNNNNN NNNNNNNNNN NNNNNNNNNN NNNNNNNNNN NNNNNNNNNN
252801 NNNNNNNNNN NNNNNNNNNN NNNNNNNNNN NNNNNNNNNN NNNNNNNNNN
252851 NNNNNNNNNN NNNNNNNNNN NNNNNNNNNN NNNNNNNNNN NNNNNNNNNN
252901 NNNNNNNNNN NNNNNNNNNN NNNNNNNNNN NNNNNNNNNN NNNNNNNNNN
252951 NNNNNNNNNN NNNNNNNNNN NNNNNNNNNN NNNNNNNNNN NNNNNNNNNN
253001 NNNNNNNNNN NNNNNNNNNN NNNNNNNNNN NNNNNNNNNN NNNNNNNNNN
253051 NNNNNNNNNN NNNNNNNNNN NNNNNNNNNN NNNNNNNNNN NNNNNNNNNN
253101 NNNNNNNNNN NNNNNNNNNN NNNNNNNNNN NNNNNNNNNN NNNNNNNNNN
253151 NNNNNNNNNN NNNNNNNNNN NNNNNNNNNN NNNNNNNNNN NNNNNNNNNN
253201 NNNNNNNNNN NNNNNNNNNN NNNNNNNNNN NNNNCAGCTA ACACTCAGCC
253251 CAAGAACCTA GTTAATAAAC CCAAGGATAA AAAGCTTAGC ATAGAGAAAC
253301 AGGTAATGGT GGCTTGGGTG GTTCAGAAAT GTCAGTAGAA TAAAGACTTG
253351 CCAAATCTTG GTAACAGACA TTACAAAATT AGGTAAAGAA GAAGTAGCTA
253401 AAGGTTTTCT TATAGGACCC AAACACCAAG AAATGAGGTG ACAGGAATTG
253451 TATGTGGTAT ATAGATTTTA TGAGAGGTGG AGTTACACCT GGAGGTGGAC
253501 ATGAATTGTA TGCTTAAGAA GAACTAAGCA GGAATGAGAA CTATGAAAGT
253551 TTTCCTTTAA ACTTAGGACT AAAGTCAGAA TGTAGTTGAG ACAGAGGTAC
253601 ATACGGGGAA ATGGGGCAAC ATTGAACTGG AGAGCCAGGT GAAGGTGTTA
253651 CTGCCAGAGA AAGTGGTCAT ATCCAAGTAT ACAAAAAGCC ACATTCTGTA
253701 CTTTGGGCCC AGAGCCTTTT TCCTCTTGTT CTTGTACCTC AAGTAGATGT
253751 TGATCAGCTT AAGTAATTGC AAGGATCAGC CCTGTATTTC TTCAATAATT
253801 ATAGAATTGG AAATCATAGA AAACAATGTT TGGTTTAAAA TGTAAATAAC
253851 ACTACCACTA TATGTTTATG GTAAGGTAGG ATGGGAAAAT AAACTCGGGA
253901 AATAGGGGAT GAGAAGGTAA AAAGAAATAA GACTGTGCTT TGGATGTCCT
253951 ATCTCTGAAA GTGGCTATCT CTGAAAGTCA CTTAAACAAT GATGCCCTGT
254001 AAGAAGCCAA GATAAGGCAG GGAATAGGAA AGAAGAGAGT TCATTCACTC
254051 ATTCATTCAT TCATTTAACA GCTGCTGAAA CGCATACTAT AGTATGTGCT
254101 ATTATACTAT AGTATGTCCT GGGTGCTGGA AATACAGACA TAAAAAGGCA
254151 TACTATTTAC CTTCAAGAGG CTCCCAATTT AGTTGGGGAG GTAGATTTGT
254201 AAAGAAAGAA AACAAAAATT ATATTACAGA AATATTTATA GTATGAGTGT
254251 GAGAAGATAG GAGACACTAG TTCAGCCTTA GTCCTTGGGG AGTAGAAGAG
254301 AGAAAGGAGG TGAAGATTCC CAGTGACTAT ATAGCTTCAT TGTATCTTGA
254351 AGAATGAACA GGGATAACAC AATCATACAA GTGTATAATG GAGAATGAGT
254401 ATTATAGGAA TACAGAGTGA CACATTATGC AGCCTATAGT TGTGATATAA
254451 TATAACATGT TTAGGAATTG AAAATATCAC ATTGATGGAT GTATCAGTCA
254501 GGGTCTAATA AGGAGACAGA AACCACATAG TAAATTGGAC AGGAAATGTT
254551 TATATAAAAA TTAATTATAA CAGGACTTGA GTAAGAAGAG ATTGGCTAAT
254601 AAGAAGTAAA GAGAACTATA AAGATGACTA AATAGCAGAA GGCAGAGCCA
254651 CCACCCCTAA GGCTGAGATA GGGTTCCCGA GATAGAATGG GAAAAAATTT
254701 TGCAATCTGA ATATCTGACC AAGGTCTAAC ACCCAGCATC TACAAGGCAC
254751 TTAAACAAAT TTACAAGAAA AAAGCCAATA ATCCTATTAA GAAGTGGGCA
254801 AAGGAACACT ATATGGTTTG GGTCTGCCCC AACCCAAATC TCACCTTGAA
254851 TTGTAGCTCC TATAATTCCC ATGTGTTGTG GGAGGGACCC AATGGGAGAT
254901 AATTGAATGA TGTGGGCGGT TCCCCCATAC TGTTCTCATG GTGGTGAATA
254951 AGTCTTATGA GATCTGATGG TTTTATAAGG GGAAACCCCT CTTGCTTGGT

FIGURE 3WWW

255001 TCTCATTCTC TCTTGCCTGT CACCATGTAA GGTGTGCGTT TCACCTTCCA
255051 CCATGATTGT GAGGCCTCCC CAGCCACATG GGAACTGTGA GTCCATTAAA
255101 CCTCTTTTTC TTTGTAAATT ACACAGTTTC AGGTATGTCT TTATCAGCAG
255151 TGTGAAAACG GGACTAATAC AGATGTGAAC AGACACTTTC TCAAAAGGAG
255201 ATATACATGT GGCCAACAAT TATATNNNNN NNNNNNNNNN NNNNNNNNNN
255251 NNNNNNNNNN NNNNNNNNNN NNNNNNNNNN NNNNNNNNNN NNNNNNNNNN
255301 NNNNNNNNNN NNNNNNNNNN NNNNNNNNNN NNNNNNNNNN NNNNNNNNNN
255351 NNNNNNNNNN NNNNNNNNNN NNNNNNNNNN NNNNNNNNNN NNNNNNNNNN
255401 NNNNNNNNNN NNNNNNNNNN NNNNNNNNNN NNNNNNNNNN NNNNNNNNNN
255451 NNNNNNNNNN NNNNNNNNNN NNNNNNNNNN NNNNNNNNNN NNNNNNNNNN
255501 NNNNNNNNNN NNNNNNNNNN NNNNNNNNNN NNNNNNNNNN NNNNNNNNNN
255551 NNNNNNNNNN NNNNNNNNNN NNNNNNNNNN NNNNNNNNNN NNNNNNNNNN
255601 NNNNNNNNNN NNNNNNNNNN NNNNNNNNNN NNNNNNNNNN NNNNNNNNNN
255651 NNNNNNNNNN NNNNNNNNNN NNNNNNNNNN NNNNNNNNNN NNNNNNNNNN
255701 NNNNNNNNNN NNNNNNNNNN NNNNNNNNNN NNNNNNNNNN NNNNNNNNNN
255751 NNNNNNNNNN NNNNNNNNNN NNNNNNNNNN NNNNNNNNNN NNNNNNNNNN
255801 NNNNNNNNNN NNNNNNNNNN NNNNNNCTGG AATCCATTAT CCCCAGCAAA
255851 CAAATGCAGG AGCAGAAAAC CAAACACTGC ATGTTCTCAC TTATAAGTGG
255901 GAGCTGAACA ATGAGACCAT AGACACAGGG AGTGGAACAA CACACACTTA
255951 GGCCTATGGT GGGGAAGAAG GGAGGGAGAG AATCAGGAGA AATAGTTAAT
256001 GCATGCTGGG CTTAGTACCT AGGTGATGGG TTGATAGTGC AGCAAATCAC
256051 CATGGCACAC GTTTACCTAT GAAACAAACC TTCACGTTCT GTACATATAC
256101 TCTGGAATTT AAAATAAAAT TTAAAAATAT AAAAGAAAGG ACAGGAGAAG
256151 CATAAAAAAT AGTTAAATAA TTAAAAAAAG AAAACCCTTC ATCTTCTAGT
256201 GTCTCTCCAG CGTACACTTC TGACAGAGCT TAAAATCATG TCAGCTGGTA
256251 AGTAATAAAA ATAATTGAAT GCCCAAGCTC AATTTTTACA AAACAAGCAA
256301 TGAAGAATGA TTTTGGAGTT CAAGGGCAAT AAATTGATAA CTGGAACAAT
256351 GGATTAAAAG GTGCTTGGAA ATATTACAAA TGGTGTAGGA GAGAAGCCAA
256401 GTTCAGATGG TTGTGGACAC AGAAGAGACA AGGGCTCAGG AAATTTCATA
256451 GTCCACATTC TGTGATGTAT GAGAGAATCT TGGTTCTGGA TCCAGCATCT
256501 TATAAAAATA GATATCTACT TGCTAAATTT TTGCATACAC TCAGACTGCA
256551 CAGCTAAATC TAAGGAAGAA AACTTGTGTA CTGAATTTGT CATGGAGTTA
256601 GCTCAGTTTT TCTTTAATTC TCAGTTCATA TAGAATCCTC AATTTATTTG
256651 AACCATGTGT GACAATATGA ATATCAAGTT TTATCATTAT TTGAGGTAAA
256701 TAATATAAAG TGATCAATGA TTACACGTGT GCTCCTGTCA GATTTTCAGA
256751 GAGGCTCACC CTCACCCAAA AATCCTAGCA AGATTATATT CTTCCAGAAT
256801 GCTCTAAAGA GCCAACTTCT CTTTCTTCCT AATATTTACT TCAATTCATA
256851 ATAACATATT AATGCACAGT GTTTGATAAA GTCTGTATTC CTCACTAAAC
256901 TGCAAGCTTC AAGAGATCAG AGACTATTTT TGTTCTCTGT AATTTTCTGA
256951 ATATCTGGTC CAGTGCCTGA CACATAGTAG TATGTCAATA ATATCCATTT
257001 CTTTAATGAA TAACTGAACA AATCATTTAG GTTTTGCTGA GATGATCTTG
257051 ATAACCCAGA AAAACCTGTC TTTTCTTATT AGTGCCGTTT AGAGGTAATG
257101 ACATTTACAT TAATGTCCTT TAAGTCGGGA GTACTTCTGA TACCAAGTGA
257151 TACTGGTCAG TGCTTTTCCT ATTTATATGT GTTAATTACA TATGAGGGTC
257201 CACTCCCCTT TTTCTCACAA TTGCTGCCTC TGGAGAAAGC TCCTGTACTT
257251 CACAAACCAC ATTTGCTTCA TCGTGACTGC TGCTTCAGGA TTCTTCCTTT
257301 TGACTGTTCT CAGAAAGCAA ATAAATGGAA AGGAGAAAAG ACTTGATTAA
257351 ATTCTCAATT TTTTTCATGG TTGTTTACTG CTCTAACCTA TTTAAAATGT
257401 ATATACTCAA TTTAGGTGAA GTATATTTGG GTTTTGAAAA ATTTGCTGCC
257451 GATAGAAAAT ATATATCTGC TATGAAAATT AATACCTTAA GCTGTGACTG
257501 TCAAAATTCT TTGAACTAAT GGGCCTTTAC AGAGAGTGCA TTATTTAGAA
257551 TCGTTTAAAA GATGCAAACA ATGCACGAGG AGATTCATAA AGCTATAAAA
257601 TTATTCTAAG CCAGAACAGA ATTTCCCTGA TCTTTAAAGG GATTTAGCTA
257651 TTAATTTTTA AATGCTGAAC ATAGTTGACA TTTCAAATTG AATTGTTACT
257701 GAGGTAATCA CATTGAATCT CTTGGTTAAA TGTTCAAAGT AGAGTCCATG
257751 AAATATGCAT GTTACCAAAT CAAGGCAAAG AGTCTTTCTT CAGAATACAT
257801 GATTTTTATT TAGATAAAAT ATTAGATGCC TTTTATTTTA AAATAAAACT
257851 ATCTCTTAAT AGGAAGATGC ACTTACTCTT CAAAGAAAAC CTGTGTGTAG
257901 AACTCAAGGG GTTTGTGCAA TGTTTACTCT ACAATTCAAC TCATTGCATA
257951 TCCATTGTTT GTGAAAAAGT GAACTGAAAA CTTGTAAGAC TCGATTTCTG
258001 ATATCAAGAT ACTTAGACTC TGATAGTATT TGGAAAACAC ACTATTTCTA
258051 GGAAGTATTA CATATCACAA ATATTTTCCA AGATCAAACT TCCCAAAGTG
258101 TAGTATTGAT AATTTTGTTG TCACATTAAA TGAGTTTATG TCATACATGA
258151 GCCAACATGT TATAATTTTA ATTCATTTTT AATTTTGTAT TAACTGTCTT
258201 CCAGTGTGTT CAGATCATAT GATACTATTT ATTTTTAGTA ACTCTCTAAA
258251 GTTTAATTTT TAAAGAAATA TTTGTAAAAG CAACTTGATT TTTTTAAAAA
258301 AATCCTAGTA AATAATAATA CATATGGCAT GCAGATGCTC ACAACTATAA
258351 AATGATTAAT GAATGGTAAT TGAGAAACAA CTCTAAAAAC TCTTTTTAAN

FIGURE 3XXX

258401 NNNNNNNNNN NNNNNNNNNN NNNNNNNTAA ATATTTGTTG AATGAAATTA
258451 ATGAATAATG TGATTTTAGA AATTTATATT TCTAATAAAA TCAAGGAGGG
258501 GGTACACCTA GTGCATTTAA TTTTTAGTTA GATCTTGGTA ATTTGTTTTG
258551 AATTAAGAGT GTTTCTTCTA CCATAGGCCT GATAGAATAT TTGGCAATGC
258601 CTATTTTTCC AGGAACTTCT ATGCCTATTT TCCTAATAGG ATCTCCTCGA
258651 CAGAAGCTAC ACAGAATATA ATAAAATATT TACAAAGCAA TAACAAAAGT
258701 GAAAATTTCT CTAATAAATA CTAGATATAG GGATTACACA ATGTATTAAT
258751 TAAAGGTACT TTTATATATT TGAATATGAA AATGTCATTT ATACTATTGA
258801 CTTCAGTTAT TAAATAGGTC ATATGTCCTG AGGTTTTAAG GTTTTAGGAA
258851 AGCTAGAGAA GAGAAAGGTT TCATAAAATA TTTCCAGGTA AGTCCTGCAG
258901 GAGACATACC AGTGTTCCAA ATGGGATGAG TTTCTGCTGA TAAGACCCAA
258951 GAGAAGGAGA GGTTTATCTT ATCAAAACAG ATGTCAGTGG CTACTACCTT
259001 TTCCAGTATT TTGCAACAAG CAGCCTCACT GGAGTCTTCT CAGCACAGTA
259051 AACAGTCGGC TATTTAGGAA CTGTAGAGAT TTCAGGGCAG AGATTATTTA
259101 CAGGTATCTG TTTTCATTTT TTTCATTGTT GTTGTTTTAN NNNNNNNNNN
259151 NNNNNNNNNN NNNNNNNNNN NNNNNNNNNN NNNNNNNNNN NNNNNNNNNN
259201 NNNNNNNNNN NNNNNNNNNN NNNNNNNNNN NNNNNNNNNN NNNNNNNNNN
259251 NNNNNNNNNN NNNNNNNNNN NNNNNNNNNN NNNNNNNNNN NNNNNNNNNN
259301 NNNNNNNNNN NNNNNNNNNN NNNNNNNNNN NNNNNNNNNN NNNNNNNNNN
259351 NNNNNNNNNN NNNNNNNNNN NNNNNNNNNN NNNNNNNNNN NNNNNNNNNN
259401 NNNNNNNNNN NNNNNNNNNN NNNNNNNNNN NNNNNNNNNN NNNNNNNNNN
259451 NNNNNNNNNN NNNNNNNNNN NNNNNNNNNN NNNNNNNNNN NNNNNNNNNN
259501 NNNNNNNNNN NNNNNNNNNN NNNNNNNNNN NNNNNNNNNN NNNNNNNNNN
259551 NNNNNNNNNN NNNNNNNNNN NNNNNNNNNN NNNNNNNNNN NNNNNNNNNN
259601 NNNNNNNNNN NNNNNNNNNN NNNNNNNNNN NNNNNNNNNN NNNNNNNNNN
259651 NNNNNNNNNN NNNNNNNNNN NNNNNNNNNN NNNNNNNNNN NNNNNNNNNN
259701 NNNNNNNNNN NNNNNNNNNN NNNNNNNNNN NNNNNNNNNN NNNNNNNNNN
259751 NNNNNNNNNN NNNNNNNNNN NNNNNNNNNN NNNNNNNNNN NNNNNNNNNN
259801 NNNNNNNNNN NNNNNNNNNN NNNNNNNNNN NNNNNNNNNN NNNNNNNNNN
259851 NNNNNNNNNN NNNNNNNNNN NNNNNNNNNN NNNNNNNNNN NNNNNNNNNN
259901 NNNNNNNNNN NNNNNNNNNN NNNNNNNNNN NNNNNNNNNN NNNNNNNNNN
259951 NNNNNNNNNN NNNNNNNNNN NNNNNNNNNN NNNNNNNNNN NNNNNNNNNN
260001 NNNNNNNNNN NNNNNNNNNN NNNNNNNNNN NNNNNNNNNN NNNNNNNNNN
260051 NNNNNNNNNN NNNNNNNNNN NNNNNNNNNN NNNNNNNNNN NNNNNNNNNN
260101 NNNNNNNNNN NNNNNNNNNN NNNNNNNNNN NNNNNNNNNN NNNNNNNNNN
260151 NNNNNNNNNN NNNNNNNNNN NNNNNNNNNN NNNNNNNNNN NNNNNNNNNN
260201 NNNNNNNNNN NNNNNNNNNN NNNNNNNNNN NNNNNNNNNN NNNNNNNNNN
260251 NNNNNNNNNN NNNNNNNNNN NNNNNNNNNN NNNNNNNNNN NNNNNNNNNN
260301 NNNNNNNNNN NNNNNNNNNN NNNNNNNNNN NNNNNNNNNN NNNNNNNNNN
260351 NNNNNNNNNN NNNNNNNNNN NNNNNNNNNN NNNNNNNNNN NNNNNNNNNN
260401 NNNNNNNNNN NNNNNNNNNN NNNNNNNNNN NNNNNNNNNN NNNNNNNNNN
260451 NNNNNNNNNN NNNNNNNNNN NNNNNNNNNN NNNNNNNNNN NNNNNNNNNN
260501 NNNNNNNNNN NNNNNNNNNN NNNNNNNNNN NNNNNNNNNN NNNNNNNNNN
260551 NNNNNNNNNN NNNNNNNNNN NNNNNNNNNN NNNNNNNNNN NNNNNNNNNN
260601 NNNNNNNNNN NNNNNNNNNN NNNNNNNNNN NNNNNNNNNN NNNNNNNNNN
260651 NNNNNNNNNN NNNNNNNNNN NNNNNNNNNN NNNNNNNNNN NNNNNNNNNN
260701 NNNNNNNNNN NNNNNNNNNN NNNNNNNNNN NNNNNNNNNN NNNNNNNNNN
260751 NNNNNNNNNN NNNNNNNNNN NNNNNNNNNN NNNNNNNNNN NNNNNNNNNN
260801 NNNNNNNNNN NNNNNNNNNN NNNNNNNNNN NNNNNNNNNN NNNNNNNNNN
260851 NNNNNNNNNN NNNNNNNNNN NNNNNNNNNN NNNNNNNNNN NNNNNNNNNN
260901 NNNNNNNNNN NNNNNNNNNN NNNNNNNNNN NNNNNNNNNN NNNNNNNNNN
260951 NNNNNNNNNN NNNNNNNNNN NNNNNNNNNN NNNNNNNNNN NNNNNNNNNN
261001 NNNNNNNNNN NNNNNNNNNN NNNNNNNNNN NNNNNNNNNN NNNNNNNNNN
261051 NNNNNNNNNN NNNNNNNNNN NNNNNNNNNN NNNNNNNNNN NNNNNNNNNN
261101 NNNNNNNNNN NNNNNNNNNN NNNNNNNNNN NNNNNNNNNN NNNNNNNNNN
261151 NNNNNNNNNN NNNNNNNNNN NNNNNNNNNN NNNNNNNNNN NNNNNNNNNN
261201 NNNNNNNNNN NNNNNNNNNN NNNNNNNNNN NNNNNNNNNN NNNNNNNNNN
261251 NNNNNNNNNN NNNNNNNNNN NNNNNNNNNN NNNNNNNNNN NNNNNNNNNN
261301 NNNNNNNNNN NNNNNNNNNN NNNNNNNNNN NNNNNNNNNN NNNNNNNNNN
261351 NNNNNNNNNN NNNNNNNNNN NNNNNNNNNN NNNNNNNNNN NNNNNNNNNN
261401 NNNNNNNNNN NNNNNNNNNN NNNNNNNNNN NNNNNNNNNN NNNNNNNNNN
261451 NNNNNNNNNN NNNNNNNNNN NNNNNNNNNN NNNNNNNNNN NNNNNNNNNN
261501 NNNNNNNNNN NNNNNNNNNN NNNNNNNNNN NNNNNNNNNN NNNNNNNNNN
261551 NNNNNNNNNN NNNNNNNNNN NNNNNNNNNN NNNNNNNNNN NNNNNNNNNN
261601 NNNNNNNNNN NNNNNNNNNN NNNNNNNNNN NNNNNNNNNN NNNNNNNNNN
261651 NNNNNNNNNN NNNNNNNNNN NNNNNNNNNN NNNNNNNNNN NNNNNNNNNN
261701 NNNNNNNNNN NNNNNNNNNN NNNNNNNNNN NNNNNNNNNN NNNNNNNNNN
261751 NNNNNNNNNN NNNNNNNNNN NNNNNNNNNN NNNNNNNNNN NNNNNNNNNN

FIGURE 3YYY

261801 NNNNNNNNNN NNNNNNNNNN NNNNNNNNNN NNNNNNNNNN NNNNNNNNNN
261851 NNNNNNNNNN NNNNNNNNNN NNNNNNNNNN NNNNNNNNNN NNNNNNNNNN
261901 NNNNNNNNNN NNNNNNNNNN NNNNNNNNNN NNNNNNNNNN NNNNNNNNNN
261951 NNNNNNNNNN NNNNNNNNNN NNNNNNNNNN NNNNNNNNNN NNNNNNNNNN
262001 NNNNNNNNNN NNNNNNNNNN NNNNNNNNNN NNNNNNNNNN NNNNNNNNNN
262051 NNNNNNNNNN NNNNNNNNNN NNNNNNNNNN NNNNNNNNNN NNNNNNNNNN
262101 NNNNNNNNNN NNNNNNNNNN NNNNNNNNNN NNNNNNNNNN NNNNNNNNNN
262151 NNNNNNNNNN NNNNNNNNNN NNNNNNNNNN NNNNNNNNNN NNNNNNNNNN
262201 NNNNNNNNNN NNNNNNNNNN NNNNNNNNNN NNNNNNNNNN NNNNNNNNNN
262251 NNNNNNNNNN NNNNNNNNNN NNNNNNNNNN NNNNNNNNNN NNNNNNNNNN
262301 NNNNNNNNNN NNNNNNNNNN NNNNNNNNNN NNNNNNNNNN NNNNNNNNNN
262351 NNNNNNNNNN NNNNNNNNNN NNNNNNNNNN NNNNNNNNNN NNNNNNNNNN
262401 NNNNNNNNNN NNNNNNNNNN NNNNNNNNNN NNNNNNNNNN NNNNNNNNNN
262451 NNNNNNNNNN NNNNNNNNNN NNNNNNNNNN NNNNNNNNNN NNNNNNNNNN
262501 NNNNNNNNNN NNNNNNNNNN NNNNNNNNNN NNNNNNNNNN NNNNNNNNNN
262551 NNNNNNNNNN NNNNNNNNNN NNNNNNNNNN NNNNNNNNNN NNNNNNNNNN
262601 NNNNNNNNNN NNNNNNNNNN NNNNNNNNNN NNNNNNNNNN NNNNNNNNNN
262651 NNNNNNNNNN NNNNNNNNNN NNNNNNNNNN NNNNNNNNNN NNNNNNNNNN
262701 NNNNNNNNNN NNNNNNNNNN NNNNNNNNNN NNNNNNNNNN NNNNNNNNNN
262751 NNNNNNNNNN NNNNNNNNNN NNNNNNNNNN NNNNNNNNNN NNNNNNNNNN
262801 NNNNNNNNNN NNNNNNNNNN NNNNNNNNNN NNNNNNNNNN NNNNNNNNNN
262851 NNNNNNNNNN NNNNNNNNNN NNNNNNNNNN NNNNNNNNNN NNNNNNNNNN
262901 NNNNNNNNNN NNNNNNNNNN NNNNNNNNNN NNNNNNNNNN NNNNNNNNNN
262951 NNNNNNNNNN NNNNNNNNNN NNNNNNNNNN NNNNNNNNNN NNNNNNNNNN
263001 NNNNNNNNNN NNNNNNNNNN NNNNNNNNNN NNNNNNNNNN NNNNNNNNNN
263051 NNNNNNNNNN NNNNNNNNNN NNNNNNNNNN NNNNNNNNNN NNNNNNNNNN
263101 NNNNNNNNNN NNNNNNNNNN NNNNNNNNNN NNNNNNNNNN NNNNNNNNNN
263151 NNNNNNNNNN NNNNNNNNNN NNNNNNNNNN NNNNNNNNNN NNNNNNNNNN
263201 NNNNNNNNNN NNNNNNNNNN NNNNNNNNNN NNNNNNNNNN NNNNNNNNNN
263251 NNNNNNNNNN NNNNNNNNNN NNNNNNNNNN NNNNNNNNNN NNNNNNNNNN
263301 NNNNNNNNNN NNNNNNNNNN NNNNNNNNNN NNNNNNNNNN NNNNNNNNNN
263351 NNNNNNNNNN NNNNNNNNNN NNNNNNNNNN NNNNNNNNNN NNNNNNNNNN
263401 NNNNNNNNNN NNNNNNNNNN NNNNNNNNNN NNNNNNNNNN NNNNNNNTTT
263451 TCTATCAAAT TTTAGAATTA ATTAATAAAG CAGATAAACG GTATTATTTA
263501 ACTGGCCTAA CAAGGCCCTA TAATGTTTGC CATTTATTCA TAGAATTAAC
263551 TTTTGTAGTA TAGATTTTTA TAGGGTGATT ATGGTGATCA TTTTCCCCAA
263601 AGTATCCCAT CAATAATTTA GGCATCTCCC ACGAGAAAAA TAGGACTAGA
263651 TCCTTTGTTT GTCAGTAATT CCAAAAAGGT GAAGAGACTT TCTTAAGCCA
263701 ATGTCATGGT TTTTCACAAC TTTGGCCATT CTTTGCAAAC TTCACATATC
263751 TACCACTATT CCTTCTTCAG CTTGCTATAC TGTTCACTCT TGCCATTCTT
263801 TTGTCCTAAG ATAAAAATAA CTGAATTAAC TGATGTTATT TGTAGGATAT
263851 GTTTTTTCCT TCCAACAAAT AAAGATTACA TGGGTTGACT TGTGTTTACC
263901 ATAAAGATGT TGAAGTCCTA ATTCTTTTTT AAAAATTTTA TTTTAATTTT
263951 GTGTTAGTCC GTTTTTATGC TGCTGATAAA GACATACCAT AGACTGGGAA
264001 GAAAAAGAGG TTTAATTGGA CTTACAGTTC CACATGACTG GGGAGGCCTC
264051 AGAATCATGG CGGAAGGTGA AAGGCACTTC TTACATGCCG GTGGCAAGAG
264101 AAAATGAGGA AGAAGCAAAA GCAGAAACCC CTGATAAACC CAGCAGATCT
264151 TATGAGACTT ATTCACTATC AGGAGAATAG CATGAGAAAG ACTGGCCCCC
264201 ATGATTCAAT TACCTCTCCC TGGGTCCCTC CCACAACATG TGAGAATTCT
264251 GGGAGATATA ATTCAAGTTG AGATTTGGGT GGGGACACAG CCAAACCATA
264301 TCACATTATA TCTTTATTTC CATAGGTTTT GAGGGGAACA GGTGGTGTTT
264351 GGTTACATAA GTTCTTTAAT GATTATTTTG TGAGATTTTG GTGCACCGAT
264401 CACCCCGAGC TCTATACCCT GTACCCAATT TTAGTCTTTT ATTCCTCACC
264451 CGTCCCGCAT TTTCCCCCGA GTCCCCCATG TCCTTTGTGT CATTCTTATG
264501 CCTTTGCACC CTCATAGCTT AGTTCCTACT TATGAGTAAG AATATATGGT
264551 GTTTGGTTTT GCCTTCCTGA GTTACTTCAC TTAAAATAAT GGTCTCCAAT
264601 TTGATTCAGC AGTTCCACTA CTGGCTCTCT ACCCAGAGGA AAAGAAGTCA
264651 TTATACAAAA AAGATACTTG CACATGCATG TTTATAGCAG CACAATTTGC
264701 AATTGCAAAC ATATGGAACC AGCCCAAATG CCCATCAATA GATAAGTGGA
264751 TAAAGAAATA TATATACCAT GGGATAGCGT TCTATCCATA AAAAGGAATG
264801 AAATAATGGC ATTTGAAATC CTCATTTTTA GTACCTATGA AAGTGAACTT
264851 ATTTAGAAAT AGAGTCTTTG CCAATAATGA GGTTAAGATG AGGTTCTTAA
264901 GGTGGACCCC AATCCCGTAT GACTGGTGTC CTTATGAAAG AGGGAAATTT
264951 GGACATAGAC ACAGATCCAT ATTACAGGGA AGACAATGTG AAGACACATG
265001 AAGAACATCA TCTATAACTA AGAAACTAAG AGGGAGGCAC GGAACAGATT
265051 CTTTATCACA GCCGTTAGAA GGCACCAACC CTGCCTACAT CTTGATATTG
265101 GACTTCTAAT TTCCAACTGT AAACTACTTA AGTAAATTTA TTGACTTACA
265151 GTATATGATG GTTTATATGG CAGTCCTACA AAACTAATAC AGGGCAAAAA

FIGURE 3ZZZ

265201 CTAACTGAGA ATCATGAGTT AGATAATAAT AACTGATTTG AGCAATTTAA
265251 ACATGTCCAG TTGGTATTAT GGCTTCAAAT AGAAAAAGAT CTTCATTGGT
265301 GATTAATTTG CAAGTCACTT ATTTTTGTAT AAATCACTCT AGACAAAGTT
265351 GAAAAGAATT TCAGGAAATA TAATTTGCCC ATTACCATAG GTTAACTTTT
265401 TGCCTGCCAT GTTGACTGTT ATCAGTTCCT TCTTAATCTA ACCTTAGATT
265451 TTCCCATTGG GATAGTACCA GTCAGCAATT AAATTAAATA TGAGTTTTTC
265501 TAAGTTTCAG GAGCTTACTG AGAGGTGTGT TTTGCTCACA GCATGTGGGT
265551 TTTCCACTCC AGGCCTCAGA TTAACTTTGA CCTAACAAGC TCTGTAACTG
265601 CTTGCAGCAC AGCACAGCAA AGTGCCCCCT CCCGCTTCTA GTTACCGTTT
265651 CTTCTGTTAT CCTTTTTATG TCAAGAGACT GCTTTCTCCT TTACCTGTGG
265701 CACTCTACAC CACATGTGAC TTAGATTTAC AGTCCAAATA AGAAATTACA
265751 GATGTATGAT GTGTACATCT GCCTTATGAG ATTTTTAAAA ATCTATCAGG
265801 ACAAGGAATC CATGGGATCC AAATTGTGTA TCTTTCATCA AACCCATTCC
265851 TTCATGCCGC TCGTTGTTTC TTTCTGATCA ATGCCACGTG AAATGAAAAG
265901 GATTTCCTTA TTAAGCAATG TCATAACCTC CTTCCTAATT TTTATATAAT
265951 ATGAATAAAT ATAACCTAAA GCAAGTGAGC CAAGAGAGAC AGTATCCACT
266001 TCTTATTTCT ACAAAGAAAA TTCAGAGATT TTGTCACATC ATGGATTTTG
266051 CTTTAACTGC ATTTACACAA CGTGTGTTAG AATGATACTA CTTAGACTGC
266101 ACAGGGAAAG CTAAATCTAA TAATTTATGT TAATACTGTG GCAATCAGTT
266151 ATTTAAAACT AAATTTGTTA AAACATCAAT AACATACTCT TTTTATAAAA
266201 CAAGATTCAA ACAATTCAAC AGGATATATA TTTTAAAAAT TTTTCTTCAA
266251 TCTTCATATG ATCGTAAAGC ATATGATATA AATCGCTAAG ATTTTTTCAT
266301 TATTTTTTGC AGAATAGCCT ATGCATCTAT AAGTATATAC AGTATATTAA
266351 AGATTATTTC TATTTATAGC GCATTTATAT TAAGTGTATT AGTCTCTCCT
266401 TTGTTAAAAC TTTAAATTAT TGTTTTAAAA CAAAATATGT ATGCTAGCTT
266451 CAACAGGGAC AATCACTATC TCACTATTGG GATAATTTAC ATTTATTTGA
266501 ATCCTAGAAA AGTTGTATAT TTTTAACGTG TTTATTGGCC ATTTATTTTT
266551 TTAATATTTT ATGAATTGCC TATTCATACC CTTTATTCAT TTGCCTACTA
266601 CTGATTATAT ATGCTATTTC TATGCAAATT GAAGCATACT GTAAATGTAT
266651 ACATTTTAAA GTTGGATCCC CTTTCATATA GTTACACACA CCACGTTGCA
266701 TTTATGGGTG TGCTATCAGT TATTTTGCCA TTCCCTGTCT TGGTGTTCTT
266751 GATGGGCATT TAAATTGTTT CATTTTTTAG TCTATTGCCA ATAGAAAATC
266801 AACATACTTG CATTGACACT GACATATTTG TATACATATT TGTTTACTTA
266851 TGTAGAATAT TAATACAATG AAAGTTAGTA TGTCAGTCAG CACATATATT
266901 TTAGATTTTT GATACATATT TTTAATTTAC TCTTTAAAAT TTGGCAGCAG
266951 TTACACTTGT ACCAGCAGTG TAGAAGAGTT TTTCTTTTCC CATACCTTAA
267001 GCAACACTCA GGGAGTATTA AATAATATAT CCTTGGATAA TCTGTTCATT
267051 TTAAAATGGT GGTTTAATTA GCAATGTTTT AATTTTTTTA AGTATGAGTA
267101 AGATTGATCT TGAGATATTT TTGTTCTTTT CTGTCGTTAC TTTTAATGCA
267151 CCAAAGATTC TCAAACTCCT CATTTGAAAA ATGAATCCAA TAGAAACGTT
267201 TTAATTTTAT ACATAAAATT TTGATTTTAA TTTCATACAT AAAAGCAAAA
267251 CAAAATTCCA AGGATATTTT TTGTTCTGAC ACCATTAAGA AACAGAGATT
267301 AATATTATTG CTAAGTCAAC AAATAATGGA AACAATAAAG CAGAGTTGCA
267351 AAATTTTAGA AATTATTCTT TTCACAACTC TCAGCATTGT TCTCTGAACT
267401 CTGGATATCT AAAAACAGTT ACTCATATCA AATGAAACTT CCAATTACCA
267451 TTTAGTAAAT GGAAACAGAA CAGAGTTATG CTTTCTCATA CATGTCTCCA
267501 TGATGGACTA GAGAGTAAAA CTGATAACTT TGGAAAAGTT CTCAATGGTA
267551 CCGTGTTATC AGAACTAGTT TCATGATGTA GAATAGTGTC TGCTTTTCTA
267601 CCATTGTAGG GAGAAAAATT GATTTTCTGG TACTTTTTTT TACCAGCAAT
267651 TAGGACTACT TGCAGCTTCT TGCAAAACAA TGGAATTATA TTAGTTAGTA
267701 GAGGAAAAAA GGGAATGAAA GAAATTCTGA GAGGCTTAGG TTATACAGAG
267751 TAGAAAAGAG ATGAGCAAAG GTGAATTTTA AGACATGTAG AATGACATAT
267801 AGAATATTTC ATATCTAGAT TGTTTTTGTC AATTTGAATT TTTTACTCAT
267851 TCAAAAATAA AGATAATGTT CATATCAATT AATATATTAG GCAAACTGGA
267901 TAACTAGATG TCGCATGTTC CAGAATTTTT CCAATTTTGT GTTTAAACTT
267951 TGACTTTTGT CAAATTTTTA CTACTGAAAT AATTTGATTT GTTCTGGGGC
268001 GTCTGGGTGT GGTGCCATAC TTTTATAGGC AATAATGATA TGTTTAGCTT
268051 CTAGAAAACC TAAAGCACTG TAACTTAAAT TTTTCTATTT CAGAGTAAAT
268101 ACTAAAGATT TTTCAGCTTG ATATGTATCA TTATGAGAAA CATAGTTTAC
268151 ATGACACCAT GTATAGAGGA TACATGTATA ATGGAAACAT GCTGGACATG
268201 TCTCCCCTTT TTATTGCAAC AAGTATATTA ATTATAGACA TATCTCATTT
268251 CATTGTGCTC ACTTAATTGT GCTGCTCGGA TACTGCATTT TTTTTTTTTT
268301 TACAAATTGA AGGTTGTGGC AATCTTGCAT AGAGCCAGTG CGTTGGCTCA
268351 ATTTTTCAAT AGAATGTATT TACTTGGTGT AATTCTTGTA GTGTTTAAAA
268401 AATTTTATTA TTATTGTATC TGTTAGGTGA TCTGTGATCA GTGATCTTTG
268451 AAATTATGTT GTCATTGTTT GGGGTGTTAT GAACCATGTT CATCAAAGAT
268501 AGTAAACTTA ATCCATAACC GTTGTGTGTA TTCTGACTAC TCTACCATCT
268551 ATCTGGCTGT TCACCTTTCT CTCTTCCTGT CCTTGGGGCT GCCTATTCCC

FIGURE 3AAAA

268601 TGAGACACAA CACTATTGAA ATTAGGCCAA TTAATTACCC TACAGTGGCC
268651 TTTAAGTGTT CAAATGTTCA AGTGAAAGGA AGAGTGTCAC ATCTCTCACT
268701 TTAAATAAAA AGCTATAAAT GATTAGGCTT AATGAGGAAG GCATGTCAAA
268751 AGCCAAAAAA GGCTCAAAGC TAATCTTTTT GTGCCAGATT GCCAAATTGT
268801 GGGTGCAGAA GTAAAGTTAT TAAAGAAAAT TAAAAGTGCT ACTCCATTAA
268851 ACACACAAAT GATAAGAAAG CAAAACAGCC TTATTGCCAA TATGGAGAAA
268901 GTTTTAGTGG TCTGGATAGA AGATCAAACC AGCCACAACA TTCCGTTAAG
268951 CCAAAACCTA ATTCAGAGAA AGACACTAAT TCTCTTTAAT TCTGTGAAGG
269001 CTGAGAGAGG TAAGGAAGTG ACAGAAGAAA AGTTGGAAGC TGACAGAGAT
269051 TGGTTCATGA GGTTTAAGGA TGAAAGTCAT GTTCATAGCA TAATAATGCA
269101 AGGTGAAGCA GCAAGTGCTG ATGTAAAAAC TGCAGCAAGT TATCCAGAAG
269151 ATCTAGCTAA TATAATGGAT GAAGGTAGCT ACACTAACAA CATATTTTAA
269201 TTTTAGACAG AGCAGCATTG TATTGGAAGA GGATGCTCTC TAGAACTTTT
269251 ACAGCTAGAG AGAAGTCAAT GCCTGACTTT GAAGCTTCAA AGGACAGACT
269301 GACACTGCTG TTACGGGCTA ATGCAGCTTG TAATGTTGAG TGGGAGTCAG
269351 TGCTCATTTG CTATTCCAAA GATTCTAGGA CCCTTAAGAA TTATGGTAAA
269401 TCTACTCTGC CTGTGCTCTG TAAATGGAAC AACAAAGCCT TGATGACAGC
269451 ACATCTATTT ATNNNNNNNN NNNNNNNNNN NNNNNNNNNN NNNNNNNNNN
269501 NNNNNNNNNN NNNNNNNNNN NNNNNNNNNN NNNNNNNNNN NNNNNNNNNN
269551 NNNNNNNNNN NNNNNNNNNN NNNNNNNNNN NNNNNNNNNN NNNNNNNNNN
269601 NNNNNNNNNN NNNNNNNNNN NNNNNNNNNN NNNNNNNNNN NNNNNNNNNN
269651 NNNNNNNNNN NNNNNNNNNN NNNNNNNNNN NNNNNNNNNN NNNNNNNNNN
269701 NNNNNNNNNN NNNNNNNNNN NNNNNNNNNN NNNNNNNNNN NNNNNNNNNN
269751 NNNNNNNNNN NNNNNNNNNN NNNNNNNNNN NNNNNNNNNN NNNNNNNNNN
269801 NNNNNNNNNN NNNNNNNNNN NNNNNNNNNN NNNNNNNNNN NNNNNNNNNN
269851 NNNNNNNNNN NNNNNNNNNN NNNNNNNNNN NNNNNNNNNN NNNNNNNNNN
269901 NNNNNNNNNN NNNNNNNNNN NNNNNNNNNN NNNNNNNNNN NNNNNNNNNN
269951 NNNNNNNNNN NNNNNNNNNN NNNNNNNNNN NNNNNNNNNN NNNNNNNNNN
270001 NNNNNNNNNN NNNNNNNNNN NNNNNNNNNN NNNNNNNNNN NNNNNNNNNN
270051 NNNNNNNNNN NNNNNNNNNN NNNNNNNNNN NNNNNNNNNN NNNNNNNNNN
270101 NNNNNNNNNN NNNNNNNNNN NNNNNNNNNN NNNNNNNNNN NNNNNNNNNN
270151 NNNNNNNNNN NNNNNNNNNN NNNNNNNNNN NNNNNNNNNN NNNNNNNNNN
270201 NNNNNNNNNN NNNNNNNNNN NNNNNNNNNN NNNNNNNNNN NNNNNNNNNN
270251 NNNNNNNNNN NNNNNNNNNN NNNNNNNNNN NNNNNNNNNN NNNNNNNNNN
270301 NNNNNNNNNN NNNNNNNNNN NNNNNNNNNN NNNNNNNNNN NNNNNNNNNN
270351 NNNNNNNNNN NNNNNNNNNN NNNNNNNNNN NNNNNNNNNN NNNNNNNNNN
270401 NNNNNNNNNN NNNNNNNNNN NNNNNNNNNN NNNNNNNNNN NNNNNNNNNN
270451 NNNNNNNNNN NNNNNNNNNN NNNNNNNNNN NNNNNNNNNN NNNNNNNNNN
270501 NNNNNNNNNN NNNNNNNNNN NNNNNNNNNN NNNNNNNNNN NNNNNNNNNN
270551 NNNNNNNNNN NNNNNNNNNN NNNNNNNNNN NNNNNNNNNN NNNNNNNNNN
270601 NNNNNNNNNN NNNNNNNNNN NNNNNNNNNN NNNNNNNNNN NNNNNNNNNN
270651 NNNNNNNNNN NNNNNNNNNN NNNNNNNNNN NNNNNNNNNN NNNNNNNNNN
270701 NNNNNNNNNN NNNNNNNNNN NNNNNNNNNN NNNNNNNNNN NNNNNNNNNN
270751 NNNNNNNNNN NNNNNNNNNN NNNNNNNNNN NNNNNNNNNN NNNNNNNNNN
270801 NNNNNNNNNN NNNNNNNNNN NNNNNNNNNN NNNNNNNNNN NNNNNNNNNN
270851 NNNNNNNNNN NNNNNNNNNN NNNNNNNNNN NNNNNNNNNN NNNNNNNNNN
270901 NNNNNNNNNN NNNNNNNNNN NNNNNNNNNN NNNNNNNNNN NNNNNNNNNN
270951 NNNNNNNNNN NNNNNNNNNN NNNNNNNNNN NNNNNNNNNN NNNNNNNNNN
271001 NNNNNNNNNN NNNNNNNNNN NNNNNNNNNN NNNNNNNNNN NNNNNNNNNN
271051 NNNNNNNNNN NNNNNNNNNN NNNNNNNNNN NNNNNNNNNN NNNNNNNNNN
271101 NNNNNNNNNN NNNNNNNNNN NNNNNNNNNN NNNNNNNNNN NNNNNNNNNN
271151 NNNNNNNNNN NNNNNNNNNN NNNNNNNNNN NNNNNNNNNN NNNNNNNNNN
271201 NNNNNNNNNN NNNNNNNNNN NNNNNNNNNN NNNNNNNNNN NNNNNNNNNN
271251 NNNNNNNNNN NNNNNNNNNN NNNNNNNNNN NNNNNNNNNN NNNNNNNNNN
271301 NNNNNNNNNN NNNNNNNNNN NNNNNNNNNN NNNNNNNNNN NNNNNNNNNN
271351 NNNNNNNNNN NNNNNNNNNN NNNNNNNNNN NNNNNNNNNN NNNNNNNNNN
271401 NNNNNNNNNN NNNNNNNNNN NNNNNNNNNN NNNNNNNNNN NNNNNNNNNN
271451 NNNNNNNNNN NNNNNNNNNN NNNNNNNNNN NNNNNNNNNN NNNNNNNNNN
271501 NNNNNNNNNN NNNNNNNNNN NNNNNNNNNN NNNNNNNNNN NNNNNNNNNN
271551 NNNNNNNNNN NNNNNNNNNN NNNNNNNNNN NNNNNNNNNN NNNNNNNNNN
271601 NNNNNNNNNN NNNNNNNNNN NNNNNNNNNN NNNNNNNNNN NNNNNNNNNN
271651 NNNNNNNNNN NNNNNNNNNN NNNNNNNNNN NNNNNNNNNN NNNNNNNNNN
271701 NNNNNNNNNN NNNNNNNNNN NNNNNNNNNN NNNNNNNNNN NNNNNNNNNN
271751 NNNNNNNNNN NNNNNNNNNN NNNNNNNNNN NNNNNNNNNN NNNNNNNNNN
271801 NNNNNNNNNN NNNNNNNNNN NNNNNNNNNN NNNNNNNNNN NNNNNNNNNN
271851 NNNNNNNNNN NNNNNNNNNN NNNNNNNNNN NNNNNNNNNN NNNNNNNNNN
271901 NNNNNNNNNN NNNNNNNNNN NNNNNNNNNN NNNNNNNNNN NNNNNNNNNN
271951 NNNNNNNNNN NNNNNNNNNN NNNNNNNNNN NNNNNNNNNN NNNNNNNNNN

FIGURE 3BBBB

272001 NNNNNNNNNN NNNNNNNNNN NNNNNNNNNN NNNNNNNNNN NNNNNNNNNN
272051 NNNNNNNNNN NNNNNNNNNN NNNNNNNNNN NNNNNNNNNN NNNNNNNNNN
272101 NNNNNNNNNN NNNNNNNNNN NNNNNNNNNN NNNNNNNNNN NNNNNNNNNN
272151 NNNNNNNNNN NNNNNNNNNN NNNNNNNNNN NNNNNNNNNN NNNNNNNNNN
272201 NNNNNNNNNN NNNNNNNNNN NNNNNNNNNN NNNNNNNNNN NNNNNNNNNN
272251 NNNNNNNNNN NNNNNNNNNN NNNNNNNNNN NNNNNNNNNN NNNNNNNNNN
272301 NNNNNNNNNN NNNNNNNNNN NNNNNNNNNN NNNNNNNNNN NNNNNNNNNN
272351 NNNNNNNNNN NNNNNNNNNN NNNNNNNNNN NNNNNNNNNN NNNNNNNNNN
272401 NNNNNNNNNN NNNNNNNNNN NNNNNNNNNN NNNNNNNNNN NNNNNNNNNN
272451 NNNNNNNNNN NNNNNNNNNN NNNNNNNNNN NNNNNNNNNN NNNNNNNNNN
272501 NNNNNNNNNN NNNNNNNNNN NNNNNNNNNN NNNNNNNNNN NNNNNNNNNN
272551 NNNNNNNNNN NNNNNNNNNN NNNNNNNNNN NNNNNNNNNN NNNNNNNNNN
272601 NNNNNNNNNN NNNNNNNNNN NNNNNNNNNN NNNNNNNNNN NNNNNNNNNN
272651 NNNNNNNNNN NNNNNNNNNN NNNNNNNNNN NNNNNNNNNN NNNNNNNNNN
272701 NNNNNNNNNN NNNNNNNNNN NNNNNNNNNN NNNNNNNNNN NNNNNNNNNN
272751 NNNNNNNNNN NNNNNNNNNN NNNNNNNNNN NNNNNNNNNN NNNNNNNNNN
272801 NNNNNNNNNN NNNNNNNNNN NNNNNNNNNN NNNNNNNNNN NNNNNNNNNN
272851 NNNNNNNNNN NNNNNNNNNN NNNNNNNNNN NNNNNNNNNN NNNNNNNNNN
272901 NNNNNNNNNN NNNNNNNNNN NNNNNNNNNN NNNNNNNNNN NNNNNNNNNN
272951 NNNNNNNNNN NNNNNNNNNN NNNNNNNNNN NNNNNNNNNN NNNNNNNNNN
273001 NNNNNNNNNN NNNNNNNNNN NNNNNNNNNN NNNNNNNNNN NNNNNNNNNN
273051 NNNNNNNNNN NNNNNNNNNN NNNNNNNNNN NNNNNNNNNN NNNNNNNNNN
273101 NNNNNNNNNN NNNNNNNNNN NNNNNNNNNN NNNNNNNNNN NNNNNNNNNN
273151 NNNNNNNNNN NNNNNNNNNN NNNNNNNNNN NNNNNNNNNN NNNNNNNNNN
273201 NNNNNNNNNN NNNNNNNNNN NNNNNNNNNN NNNNNNNNNN NNNNNNNNNN
273251 NNNNNNNNNN NNNNNNNNNN NNNNNNNNNN NNNNNNNNNN NNNNNNNNNN
273301 NNNNNNNNNN NNNNNNNNNN NNNNNNNNNN NNNNNNNNNN NNNNNNNNNN
273351 NNNNNNNNNN NNNNNNNNNN NNNNNNNNNN NNNNNNNNNN NNNNNNNNNN
273401 NNNNNNNNNN NNNNNNNNNN NNNNNNNNNN NNNNNNNNNN NNNNNNNNNN
273451 NNNNNNNNNN NNNNNNNNNN NNNNNNNNNN NNNNNNNNNN NNNNNNNNNN
273501 NNNNNNNNNN NNNNNNNNNN NNNNNNNNNN NNNNNNNNNN NNNNNNNNNN
273551 NNNNNNNNNN NNNNNNNNNN NCTGTTTATC TCTATTAAAC TAATACATCC
273601 TTTACAAATG ATTATGTGTA TTTTTTCTTT CCAGGTTAGA TTGAAACTGA
273651 CACACTTATA CAGTTCTGGT GTAAGTATAC ATTTTAGTCA GCATACCAGT
273701 AGGCCTTCAA TGTCAATACA CTTTAACTAT GTGATTCCAT TTCTATTCTA
273751 AGGATATATG CACACATAAA AATCAGAACT TGCATTCGCT GTAGTATTAT
273801 TTAAAAAGAA AAGATAAAAT AATCTAGATG TCCAAATATG AGATTATCAA
273851 CATTATGATA TACCATAACA ATAATACAAT TTTCATGCAT CAATTAAAAT
273901 AATATTTAAA ATATTATTAT ATTTTTAAAA TAATGTTAGA AAATGCTGAT
273951 TATATTTTGA TAAAATTTGG GGAACAAAAT TTATATACCA ACTTAAAATT
274001 ATTTTCAACT TGAATGCAAA TTTTGAAAGA AAATTTATCC AAATATTATG
274051 TGTTAATCTT TGTAAATTGA GAAGCTTTTT TGCAATTATA AAATAAGCAT
274101 ATATCATTTT AAAAATTGTC TTTGTTTTTT AATTAATTTT TGATTGAAAA
274151 GTAAAAATTA TATATGTTTA TCATGTATAA CATGTTGTTT TGAAATATGT
274201 ATATATTGTA GAATGGCTAC ATTGAGCTAA TTAGCATATG CATCACCTCA
274251 CATTTATCAT TTTTGTGGTA AGAACACTTA AAATCTCTTT TGCAGTTATG
274301 ATTTCACATT TTGCACTTTA TTTGCAATTT TCAAAAATGA GCGTGTATTA
274351 CTTTTAATGT TGGAAAAATA TAAAACTATT ACAAAAATTG TTTATGAATC
274401 AGATATGGGA TTCACACATG AAGAAAGCAG AAAGATGTGC TAAATAGCGT
274451 GTTATTTATT TCATTTGATT TTTATATTAT ATAAGATCAG AAATGTATAA
274501 AAATATATGT TCACTTGATA ATTTTTCGTA AATATCTTAA ATTACCCTTT
274551 ATCTATTTAA AAAATTGTTT AGCATGTCAG TGTCAGCTAT GCTCAATTTT
274601 CCCCCTGCTT TTATTCATCC ATATTATGTG TTCTCTGGAT TTTGCCCTTG
274651 CATACACTCC CTTTAAAGCT TTCATTTAAG AAACTTTTAA TCAATTCGAG
274701 GGCAGTTTAT TTGTTGACTT TCACGTTAGT ATAAAATTCT ACTATTTATG
274751 CTATTAATTT TATTTAGGAT CTGCCAGTCT CTTAGAAGAA TCAGTGATAT
274801 GCGTGTAACA CCTGTAAAAT AAAAATACCC ACGAGTATTT AGTCTTTTCT
274851 CTGGCCTGGG GCACAATCAG TACTGCATGT TTCTTTTTTC TTTTATTTGA
274901 CAAAATTGCC AGTAAATACG ATTAAATATA TTCAGTATTG ACCAACATTT
274951 TTCTTACTTT TTAAAATGTA AGCATTAAAG TTTACTATAA TCATTTTGAA
275001 AGCAGTCTGA CTAAATTTAT AGCCTCACTT TTTTTTCTCA TGCCACAGAT
275051 ATTTCAATTA GAAAATGCTT TGGCTTTATG ATACATAATA AAATATCTTT
275101 GAGTCCCTAA ATTTGTCCAT TCTAACTTAA TATTCTATCT ATAACTCAGA
275151 TCTACCATGA GAGCAAATTA TGTAACCCCA GCTAATTTGC CGTAAGAATT
275201 AACAGTTGTG CTTAATCTCC TTCAACTTAT TTTAACAAGT GTCTTTTGTT
275251 AAGACAGATG CTGCCTCAAA TTCACTTTTC CTGCCCCTGC CATACATCTT
275301 TGTGAAACAT GTTTCTACTT CCACTTCTCT GCCTCTGCCT GGCATTCCTA
275351 ATTTATATCT TCATCATAAG TATTTCACAA AACCATTCTT TAGTGTGACA

FIGURE 3CCCC

275401 GTGATCTCAT GGTTGATTCC AATATCGCTT TTTGTTTTAG GATTAAGACT
275451 ACTTGCTATT AATAATTGAA GATTATTGAC CATTCGTTAG CTTTGACGCT
275501 CTTTGGTATT TGCTTTCTGG ACAGTCCTCT CTTTTTTATA TCACATGCTT
275551 ATTGCACTCA TTGTTTACAC CACTTCTGCA AAACCTCTGA CATATGGCAG
275601 ACCAAGACTG ATCCTGAGCT TCTTAGCTTT CTATTTCCAC CTACCTTTCT
275651 CTATAGCGTT TTTATCAAAC TATATTGATA AATGATTCCC AGGTCTTTTT
275701 TTCTACTCCG AATCTTGTTT CTTCTACCCA AGTCTGTACT TCTTGTATTC
275751 AGTATTACCT ACAAATGAAT GTTTACCACT ACTTCAAATC TTTCTTAAAA
275801 TATAAATTTC CAGCATTTTC ACTTTCAGAA ATTTATTCAA CACACAGATT
275851 GCACAAATTT GCAGGCATAT ATACACAAAG ATAATCAGTG GATCATTATT
275901 TGTAATAGTT AAGTAATGAA AAAATCTGAA AGTTCATTAA TGGAAAAATG
275951 GGTAAATGAG GTTGTTGTAT ATACATACAT GAAATTCTAT TCACTAGCAA
276001 AAATGACAAG GTAAATTTGA GCTAGAAAGA TGTCCATGAT ATGAGGCAAA
276051 ATGAAAAAAA TGGGAAACAT AACAAACAGT ACAGTGAGTT AGCAGATGCA
276101 TGTCAAACCC TTAAAATGCT TCTTCAAAGG TTTGGATAGG GGTGGTACAT
276151 TTATTTCTTA AAGTGTGTGT GTGATGGTCA CAACAATAGA AAGCAGGATG
276201 CTTTTTTTTA TCATTATACT TGAAGTTCTA GGGTACATGT GCACAACGTG
276251 CAGTTTGTTA CATATGTATA CATGTGCCAT GTTGGTGTGC TGCACCCATT
276301 AACTCATCAT TTACATTAGG TATATCTCCT AATGCTATCC CTCCCTTTTC
276351 CCCCTACCCC ATGACAGGCC CCAGTGTGTG ATGTTCCCCT TCCTGTGTCC
276401 AAGTGTTCTT ATTGTTCAGT TCCAAAACCA CAATGAGATA CCATCTCATA
276451 CCAGTTAGAA TGGCGATCAT TAAAAAGTCA GGATGCTTTT TAACAATATT
276501 ACGCTTCTTT CATTAAAATT TTTACTTTTG TTGAAAATAG TTTCAATTAA
276551 AAACAGATTG CCAGTTTTCC GTATTTACTA CTTTTAATGG CAGCCCTTTT
276601 CTCTTATTCA ATTTTTAAAT CTTACACTAA TCATAGGCGA TGGGGATCAT
276651 TTTTCTCTCC ATCTTAAAGA TAAGAAAACT AAAACTTCCA AATTATAGGT
276701 TACCTTACTC AAGATATCAT ACACCCAGTA NNNNNNNNNN NNNNNNNNNN
276751 NNNNNNNNNN NNNNNNNNNN NNNNNNNNNN NNNNNNNNNN NNNNNNNNNN
276801 NNNNNNNNNN NNNNNNNNNN NNNNNNNNNN NNNNNNNNNN NNNNNNNNNN
276851 NNNNNNNNNN NNNNNNNNNN NNNNNNNNNN NNNNNNNNNN NNNNNNNNNN
276901 NNNNNNNNNN NNNNNNNNNN NNNNNNNNNN NNNNNNNNNN NNNNNNNNNN
276951 NNNNNNNNNN NNNNNNNNNN NNNNNNNNNN NNNNNNNNNN NNNNNNNNNN
277001 NNNNNNNNNN NNNNNNNNNN NNNNNNNNNN NNNNNNNNNN NNNNNNNNNN
277051 NNNNNNNNNN NNNNNNNNNN NNNNNNNNNN NNNNNNNNNN NNNNNNNNNN
277101 NNNNNNNNNN NNNNNNNNNN NNNNNNNNNN NNNNNNNNNN NNNNNNNNNN
277151 NNNNNNNNNN NNNNNNNNNN NNNNNNNNNN NNNNNNNNNN NNNNNNNNNN
277201 NNNNNNNNNN NNNNNNNNNN NNNNNNNNNN NNNNNNNNNN NNNNNNNNNN
277251 NNNNNNNNNN NNNNNNNNNN NNNNNNNNNN NNNNNNNNNN NNNNNNNNNN
277301 NNNNNNNNNN NNNNNNNNNN NNNNNNNNNN NNNNNNNNNN NNNNNNNNNN
277351 NNNNNNNNNN NNNNNNNNNN NNNNNNNNNN NNNNNNNNNN NNNNNNNNNN
277401 NNNNNNNNNN NNNNNNNNNN NNNNNNNNNN NNNNNNNNNN NNNNNNNNNN
277451 NNNNNNNNNN NNNNNNNNNN NNNNNNNNNN NNNNNNNNNN NNNNNNNNNN
277501 NNNNNNNNNN NNNNNNNNNN NNNNNNNNNN NNNNNNNNNN NNNNNNNNNN
277551 NNNNNNNNNN NNNNNNNNNN NNNNNNNNNN NNNNNNNNNN NNNNNNNNNN
277601 NNNNNNNNNN NNNNNNNNNN NNNNNNNNNN NNNNNNNNNN NNNNNNNNNN
277651 NNNNNNNNNN NNNNNNNNNN NNNNNNNNNN NNNNNNNNNN NNNNNNNNNN
277701 NNNNNNNNNN NNNNNNNNNN NNNNNNNNNN NNNNNNNNNN NNNNNNNNNN
277751 NNNNNNNNNN NNNNNNNNNN NNNNNNNNNN NNNNNNNNNN NNNNNNNNNN
277801 NNNNNNNNNN NNNNNNNNNN NNNNNNNNNN NNNNNNNNNN NNNNNNNNNN
277851 NNNNNNNNNN NNNNNNNNNN NNNNNNNNNN NNNNNNNNNN NNNNNNNNNN
277901 NNNNNNNNNN NNNNNNNNNN NNNNNNNNNN NNNNNNNNNN NNNNNNNNNN
277951 NNNNNNNNNN NNNNNNNNNN NNNNNNNNNN NNNNNNNNNN NNNNNNNNNN
278001 NNNNNNNNNN NNNNNNNNNN NNNNNNNNNN NNNNNNNNNN NNNNNNNNNN
278051 NNNNNNNNNN NNNNNNNNNN NNNNNNNNNN NNNNNNNNNN NNNNNNNNNN
278101 NNNNNNNNNN NNNNNNNNNN NNNNNNNNNN NNNNNNNNNN NNNNNNNNNN
278151 NNNNNNNNNN NNNNNNNNNN NNNNNNNNNN NNNNNNNNNN NNNNNNNNNN
278201 NNNNNNNNNN NNNNNNNNNN NNNNNNNNNN NNNNNNNNNN NNNNNNNNNN
278251 NNNNNNNNNN NNNNNNNNNN NNNNNNNNNN NNNNNNNNNN NNNNNNNNNN
278301 NNNNNNNNNN NNNNNNNNNN NNNNNNNNNN NNNNNNNNNN NNNNNNNNNN
278351 NNNNNNNNNN NNNNNNNNNN NNNNNNNNNN NNNNNNNNNN NNNNNNNNNN
278401 NNNNNNNNNN NNNNNNNNNN NNNNNNNNNN NNNNNNNNNN NNNNNNNNNN
278451 NNNNNNNNNN NNNNNNNNNN NNNNNNNNNN NNNNNNNNNN NNNNNNNNNN
278501 NNNNNNNNNN NNNNNNNNNN NNNNNNNNNN NNNNNNNNNN NNNNNNNNNN
278551 NNNNNNNNNN NNNNNNNNNN NNNNNNNNNN NNNNNNNNNN NNNNNNNNNN
278601 NNNNNNNNNN NNNNNNNNNN NNNNNNNNNN NNNNNNNNNN NNNNNNNNNN
278651 NNNNNNNNNN NNNNNNNNNN NNNNNNNNNN NNNNNNNNNN NNNNNNNNNN
278701 NNNNNNNNNN NNNNNNNNNN NNNNNNNNNN NNNNNNNNNN NNNNNNNNNN
278751 NNNNNNNNNN NNNNNNNNNN NNNNNNNNNN NNNNNNNNNN NNNNNNNNNN

FIGURE 3DDDD

278801 NNNNNNNNNN NNNNNNNNNN NNNNNNNNNN NNNNNNNNNN NNNNNNNNNN
278851 NNNNNNNNNN NNNNNNNNNN NNNNNNNNNN NNNNNNNNNN NNNNNNNNNN
278901 NNNNNNNNNN NNNNNNNNNN NNNNNNNNNN NNNNNNNNNN NNNNNNNNNN
278951 NNNNNNNNNN NNNNNNNNNN NNNNNNNNNN NNNNNNNNNN NNNNNNNNNN
279001 NNNNNNNNNN NNNNNNNNNN NNNNNNNNNN NNNNNNNNNN NNNNNNNNNN
279051 NNNNNNNNNN NNNNNNNNNN NNNNNNNNNN NNNNNNNNNN NNNNNNNNNN
279101 NNNNNNNNNN NNNNNNNNNN NNNNNNNNNN NNNNNNNNNN NNNNNNNNNN
279151 NNNNNNNNNN NNNNNNNNNN NNNNNNNNNN NNNNNNNNNN NNNNNNNNNN
279201 NNNNNNNNNN NNNNNNNNNN NNNNNNNNNN NNNNNNNNNN NNNNNNNNNN
279251 NNNNNNNNNN NNNNNNNNNN NNNNNNNNNN NNNNNNNNNN NNNNNNNNNN
279301 NNNNNNNNNN NNNNNNNNNN NNNNNNNNNN NNNNNNNNNN NNNNNNNNNN
279351 NNNNNNNNNN NNNNNNNNNN NNNNNNNNNN NNNNNNNNNN NNNNNNNNNN
279401 NNNNNNNNNN NNNNNNNNNN NNNNNNNNNN NNNNNNNNNN NNNNNNNNNN
279451 NNNNNNNNNN NNNNNNNNNN NNNNNNNNNN NNNNNNNNNN NNNNNNNNNN
279501 NNNNNNNNNN NNNNNNNNNN NNNNNNNNNN NNNNNNNNNN NNNNNNNNNN
279551 NNNNNNNNNN NNNNNNNNNN NNNNNNNNNN NNNNNNNNNN NNNNNNNNNN
279601 NNNNNNNNNN NNNNNNNNNN NNNNNNNNNN NNNNNNNNNN NNNNNNNNNN
279651 NNNNNNNNNN NNNNNNNNNN NNNNNNNNNN NNNNNNNNNN NNNNNNNNNN
279701 NNNNNNNNNN NNNNNNNNNN NNNNNNNNNN NNNNNNNNNN NNNNNNNNNN
279751 NNNNNNNNNN NNNNNNNNNN NNNNNNNNNN NNNNNNNNNN NNNNNNNNNN
279801 NNNNNNNNNN NNNNNNNNNN NNNNNNNNNN NNNNNNNNNN NNNNNNNNNN
279851 NNNNNNNNNN NNNNNNNNNN NNNNNNNNNN NNNNNNNNNN NNNNNNNNNN
279901 NNNNNNNNNN NNNNNNNNNN NNNNNNNNNN NNNNNNNNNN NNNNNNNNNN
279951 NNNNNNNNNN NNNNNNNNNN NNNNNNNNNN NNNNNNNNNN NNNNNNNNNN
280001 NNNNNNNNNN NNNNNNNNNN NNNNNNNNNN NNNNNNNNNN NNNNNNNNNN
280051 NNNNNNNNNN NNNNNNNNNN NNNNNNNNNN NNNNNNNNNN NNNNNNNNNN
280101 NNNNNNNNNN NNNNNNNNNN NNNNNNNNNN NNNNNNNNNN NNNNNNNNNN
280151 NNNNNNNNNN NNNNNNNNNN NNNNNNNNNN NNNNNNNNNN NNNNNNNNNN
280201 NNNNNNNNNN NNNNNNNNNN NNNNNNNNNN NNNNNNNNNN NNNNNNNNNN
280251 NNNNNNNNNN NNNNNNNNNN NNNNNNNNNN NNNNNNNNNN NNNNNNNNNN
280301 NNNNNNNNNN NNNNNNNNNN NNNNNNNNNN NNNNNNNNNN NNNNNNNNNN
280351 NNNNNNNNNN NNNNNNNNNN NNNNNNNNNN NNNNNNNNNN NNNNNNNNNN
280401 NNACTCCAGC CTGGTGACAG AGCAAGACTC CATCTAAAAA ATTAATTAAT
280451 TAATTAACTC AATTGAAGAA ACATGTTAAG GGGGGTTAAA TCACTTGTTA
280501 AAGATACAGT ATTAGTAAGC AGGCTCCCAG GAATTGAATG GAAGGGTTAT
280551 GTGACTGTAA TGTCCATACT GGAATTTCAA TCATTACAAA TTGATGGACA
280601 ATGAATTAAT CTTATCAACT TTTTGGCAAA TACTGAGCAA GGATTATTCA
280651 TGTGAGAAGG TCAGTCTGCC TTCTAGGGAC TCATTCTGTC TCCATTCTTA
280701 GATACCTAGA GCTGTTTGGT CCCTCAAGTC TGTGGGTTCT CTGGAGAAGC
280751 AAGTCTGAAC TCCAGCTATA CAGCCAGAAG GACTTTCATG ATTCATTTCT
280801 CTTAGTCTTG TTTCTTACCT TCCTGCACCT GAAGACACAG ATTTCCTGAG
280851 ACATACTTTT GTGTTTGATG TTTTCATTTC CCCTGACTCT ACTTTGTTTC
280901 CACAGTCTTC TGTTCCTCCT CTTCTTCTGG ATTATTCTCC ACTTTAGATC
280951 TCAGTGCCTG CCTGGGAGAG GACTGGTTTT CTTCATTCCT TTGTACTTTG
281001 ATCGTCAGCC TCTATGATTT CCTCCCAGTG TCTGTGTCCC TTGATTCCCT
281051 CAAATGCTAA TAAATGTTGG TCACTCTACC AGTGCTTGGT TGGCTTTATT
281101 GCTCAACATT CCATATGGGA AAGGGGTAAC AGNNNNNNNN NNNNNNNNNN
281151 NNNNNNNNNN NNNNNNNNNN NNNNNNNNNN NNNNNNNNNN NNNNNNNNNN
281201 NNNNNNNNNN NNNNNNNNNN NNNNNNNNNN NNNNNNNNNN NNNNNNNNNN
281251 NNNNNNNNNN NNNNNNNNNN NNNNNNNNNN NNNNNNNNNN NNNNNNNNNN
281301 NNNNNNNNNN NNNNNNNNNN NNNNNNNNNN NNNNNNNNNN NNNNNNNNNN
281351 NNNNNNNNNN NNNNNNNNNN NNNNNNNNNN NNNNNNNNNN NNNNNNNNNN
281401 NNNNNNNNNN NTACTTGTTT GAAAACGGCC AAAACTTAAA TAATTTCTTA
281451 GGAAAAAAGG TTACCTAATA TCAACCTGGT TAATAGATGT TGAATATTCC
281501 AGGCCTTTTC CAGGTTGGCT TTTTACCATT GATGACAATA TTTTAGAAAA
281551 TTAAAATCAT ACTGAGGTCA AAAGTCCATA GGCTATTTTT CCTTACTCAT
281601 TTTTCTGGAG GGTGATCTNT CTGTAATCTT TCTGTAATCT TCTGATGGTG
281651 GTATATCAAC AATCTGAAAT TAATGCAAAT TATCTTTCCC CTTGATGTTG
281701 CCCTCAAAAT GTGGAGAATT CCAAAGTCTC AGAAATCTGT CATTTTCCAA
281751 TTCCACACAT TGTTTTCAAA AGGAGCTACT CAAACAAATA GAAATCAAAA
281801 CGATCTATGC CTGTTCTCCT CTGGATTTGT GTATCAGTAG CTTCAAATCC
281851 TATTATATGT AAATGATAAT AAAATCTTAC ATTGCTATTC ACGTGGCTTC
281901 ACAGCAGAGC CAGCTTTCAC CCTAGGAGTC TCTAGAAGTA GGAAGTGACT
281951 TCCCTAGAGC ATTTGGTAAG CCCATCAAAC TCTAACCATT TTGAAAGTTG
282001 AGTGAGTCAT TAGTTTTATG ACCTATCTAG CTTTAAAAAC ATGGAAAACT
282051 GATGTGATGC TGGTTTAATT GAAAACAAAC AGGGAGATTA TTTTCACCAC
282101 TTCCTGAATA AGGGATAAAG CAATATAAAT CATATTGAAA TTTTGTCTGT
282151 ATTTAATTAC TGAGTAGTGT GCTGCAATTT ATACTTTAAG TACTAATTAT

FIGURE 3EEEE

282201 TCTTAATGTA ATTATATTTA ATTATTATAA TTGCTATTCA TATCTTATGT
282251 TCTAATAGAG ACATATCATA TCGAGGGCCT TTTTCACAAA ATTACTATAT
282301 TCCCTTCATG CTAGAAAACA GAATAGAAAA TTTACCTTAA TTTAGTTGTA
282351 ATAAGCTATT CGTTTCCTCA TGTATTGCAA ACTGTTTCAA AATGGATTAA
282401 GTTACTAATT TTTATCTTTT TTATTAGGTT ATTTTGACAA GGATGTTTTA
282451 TAACAAATGC TGGCAACCCT TTGAAATTAA AAAATAGAAA TAGCATGGTT
282501 TGTTTGTATA TAAATTATGG CTTTATACAT TTTATACATT TACTTGTAGA
282551 TCACACTATA AATTCACATC TTTTTTCTCC TGCGGGCATT GCAGTATAAA
282601 TAAAAGGGTG GTTAGACATT GTAATTTTTT TGCTCTAAAT TTATAATGCA
282651 TTACAATATA TTCAGCTCAA TAAGTTTGTA AATTATAGCA CATAAGATTT
282701 GAAAATTCAA GAAATGGAAG GGAAAAGGCA ATCTACAGTA ACTAAAAAAC
282751 AAATTCTAAT TCATTGCCTC ATATGATCTG AATTTAATTT GCTTACATTT
282801 GACAAGAGAA ACACCTATTT ACAGTGTTCT TTTTGATATA GTACATATAA
282851 AGCTGAAATA CTGTGTTTCA GCTTGGGTAA TGGAGTCATT ACCTCAATTT
282901 TAAACATTCT GTAACCTGAA ATTGGGATTT ATAATGGACT CATTGGCTGA
282951 CCAAAATCAC CACAAGTAAA AACGATTTCT AGAAACTTAG AGAGTTGAGA
283001 TTTATTTTTT AAATTGCTTT TTTAGATAGA ATGAGGAATA ATACTCAGGA
283051 AAATTTGAAA GCATGTACCT TTAGAACCAA GAAAAATTTA CGAATATATG
283101 TTGCAGTGAA TAAAAGAGTT AGATGTTTTA ACACCTGTTT ACACTAATAA
283151 TTACAGTAAT AATATTGAAC ATTTATAGTG TATTTAGCAG GTGCAGCCAT
283201 TTACCAAAAA TTCTATGTGT ATTAATTTTC ACAAAGGCCT TGTAGTTAAG
283251 ATATTACTCT TCCCTCTTCC ATTTTCCCAG GACAACAGGC ACAAACCAAC
283301 ACTGTCCCAA GAAAATTACG TTATGTGATT TCCCATCCTG ATCAATTTTC
283351 AGACAGTAGA GCATTTTGCA AAATAGGTTT TCCTTTGATG TTCTCTATAT
283401 GATATGGAAA ATTCCATAGT CTCAGAAGTC TTTGCCATTT TCTATGCCAT
283451 TAGCTCAAAA GGGATCCCCG CAAACTAACT GGAAACAATA TTAAGACCTA
283501 CTATGGATCA GAGTCTCAAT AACCATAAAA ACAAAAATAT CTGGAGATCA
283551 ATGTACACTG GATCGGTGTT TTTAAGAAGA TTACATTCCG AACAAATGTT
283601 ATCCTAAGAA TCTGAGTAAA TTAGACTAAG TGGAAAAACT GTTTATGTAA
283651 AGCTATTTGT GGAGATTTTT TGCATAGGAA GTGTATACAG AAGTTCAAAG
283701 GCATAGATTC TGTGTCCAAG AGAAAAAAGT TGAATGTAGA GGTCATCATT
283751 TAATAACTTT GTGACCCTGA AAAATACACT CAATCTTTAA ACCTTCTGTT
283801 TTCTATTCTG TAAGATTAGG CTAATATGTA TGTTAAATAA TATTTGTGGT
283851 GATTAAAGGG AGAATGACCA CATTCTATTT AGTGTGGACC CACTATTCAA
283901 TCATTGAATG TTAGCTATTT ATTATTATAT GAATGTATTT ATTGTAAAGG
283951 CCATGTATTT TTCTTGCTGT GAAGATGACT CTCAGTCTGG TGGTATCTTA
284001 TCATTGTAGT ACTTTAAGAA AAAGAAATGT AAACCTTTGA AAAAGAGAAA
284051 TACTCAGGCT TCATGTCTGT ATCTTCTAAG TTAGTGTTGT AGTATCTGGC
284101 CTGAACATTT GCTTCTTGGT GGAGGGGTTG GCGTTGTGGA GGGTGATGAG
284151 GCCCACTTGC TTTCTGATGG GTTGAGAACC ACTGTGATAG GGAACTTGGT
284201 GTACTGGAAT ATCCTCAATT AAAATTTTGT GTTTTTTTAA ATGCTATATT
284251 TTGGTTAACA AGGTTTTTTT TTTTTAAAAA AAAAAGCAAA AAATTAACAT
284301 ATTATCACCA CATGTAACAA CGTAAACAAA AGATAGAACG TTTTCCCTGG
284351 GAAAGCACAG CTTTGATTTT ACAAATTCTT ACCATATTTA CTCTTTCTTT
284401 TATTTAACAG TGTGTGTCTA TACCCAGATC TTATTCTGCA CCTGTCATTG
284451 TGCTGAGCAA TGGGGATATC ATAGAGAAGG TTGGAACGAG AGTGACAACA
284501 GGAGAGACAG TTATAGACAA AATGTTAATC AAATAGAGAT CACAGTTTTA
284551 GTCCTGTCAG TGTATGGATA CCCCTCCCTA AACTCCAAAA GTATGGCTTC
284601 TATAAATTGT CTTGGAGGAC TAGTCTTAGG CCTGAGCGAA AATAAGGTAT
284651 TTGAGTTTTC CCTCAAATAC CAGTTTTGAG GTTTGTTTCT TTCAATGAAT
284701 GTGGAAGACA AAAGTATATC TATAAATCTG GCTGAGTGAA TTAACTCAGC
284751 AGGTCTATTA TTATTATCAT AATTTGATGA GTTACTAGCA TTCTTTTCTT
284801 AGGGTATAAA AAAACTGGCT ACCAAGGTTA TTGGTACTCT TTTCAACTTG
284851 AAGTGTGACT CCTTGATGGA AGAAGCCATA TTATAATATC GAGCAATTGT
284901 ATTTAGACCC ATCCAGGTGC ATCAGGAGAA CATATATGAG TCAACATGGG
284951 TCCAAGAATT AGACAAACTT AGGTTTCTTC CATGTTTCAC TATTTATTGG
285001 CTGTTTTAGT TAGAGTTACA CAATTGCAAA AAAAAAAGAA AAATCCCAAA
285051 TATATCTATG GCTTAACCAA TAAAAATGCA AAGCAGCTCT CCAACACAGC
285101 ATGATTCAGG GAGCTAGGCC TCTGCTATCT TGTAGCTCCA GTCTTGTGTA
285151 GGGTCTCAAA TCCACTTGGT GGGTAGAATA AGAGAACCTG GAGAAGGCTG
285201 ACTAGCTTAT TAAATATCTT GACCTGGAAG TGACACAGTC ACCTTTATTC
285251 ATTGGTGAGA ACCCACCAAC AAACTTATTT GGATAGAAAT GGGAGCTGAG
285301 AAATATAATC CTTGGTTATA CAGCTACTTC CTTGCTGTAA GTCTATAACT
285351 TTTGGTGGAT ATCTAGCCAT CTTATCAAGC TAACTGTATG ACTTTAAAAA
285401 CTGAAATTCT ATCATTCTGA TTCCTGATTT AAAAGGGGAA TAAAGCTGGA
285451 TGTAGTGGCT CACTCCTGTA ATCCCAGCAT CTTGGGAGGC TGAGGTGGGT
285501 GGATCACTTG AGGTCAGGAG TTCGAGACCA GCCTGGCCAA CATGGCAAAA
285551 CTGCTTCTCT ACCAAAAAAT ACAAAAATTA GCCGGTCATG ATGGCATGTG

FIGURE 3FFFF

285601 CCTGTAATCC CAGCTGCCCA GGAGGCTGAG GCATGAGAAT TGCTTGAACC
285651 TGGGAGGCAG AGTTTGCAGT GGGCTGAGAT CGTGTAACTG CACTCCAGCC
285701 TGGGTGACAC AGGAAGACTC CGTCTCAAAA AAAAATAAAA TAAAAATAAA
285751 CGGGATAATA CGCCTGAATG ATAGGTAATG AAGATTAACT GAGATAGTGT
285801 GCATAATACT TGACATATGA TCTAATCATA ATATGAGTTC TCAATATATG
285851 GTAACATGCT ATAATTATTA TCATCGTGTG ATCCATGCTC TGTATAAGTG
285901 GAATGATGAC TTCCTTCTCC GTCTCTTTAG GGTGATGTAA TAGTTTTATT
285951 CCATTCCTCC CGAATGCTGA TTAATCTTAT CATTTTATAA AATTACAGCT
286001 ATTTATGACC TTTTTAAATG AACATTCTTT CCCACGGGAG TAGTAAGACC
286051 AAATACTTCC TTTTTGTATC TAGGACCTCT GTCAGGGAGA AATTTCAATT
286101 CTGAGATTGA AAATGGCTCT TTTGGGTCAG TAACTATATC GCTTCAGATA
286151 CAGCGTGCAT AGAGCAAAGG GGTTACCTCT GGGATTGGCT AAGTCATGGC
286201 CAGATGATCC TCCATGCTGC TGACCCTTAC AGCGTTAGAA AACCTATACT
286251 AGTCACAATA TAAGGAGTTC ACTCTCTGCT ATGTAGCGTC AAAGTCATAT
286301 GGCCTTTCAA TAAAGTTTCT TTTATTCCCT GTTCTGAAAT ATATAGTTAC
286351 TGTTAACATG TGTTATGTTG ATTATGTTAT GTTTAGTTGC ATATTTGTAA
286401 ACTACATATC TGTTTTTGTT TTCACGTGGA AATTATGAAA TCCTAGAGCA
286451 AATAATCAGT TTCTCTTATT AGACCCCCCT AGCAATAAAT ATTTCCAAAC
286501 CATTAAAGAG TGACTTGGTA GAATTTAATA TTCTGGTCAC GATATCAAAA
286551 GTAAACAGTA ACTTTTAATC ACTTTCTATT CTCATTATAT CTCCTGTCAT
286601 AACAAGTATT TTCTCAGTTT TTAAATGGAA GAACAAGCAA GCAACAATTT
286651 AACATCAGTT GTCATCGTCT CTTAAAGATT GTGTTGTTGC ATTAGTTTAA
286701 CTTCAAATCA AAGTTTAGAA ATATTAGTGC TAGGCAGCTA TTTATACTTG
286751 AGTTATTAAC ATTTGCTCAG TTATTAAAAT CTGGTTATTT CTTTGAGGTT
286801 TCAATGATTG AAATATAAAC AAGAAAGAGG GGAAAATGTC AAGTGTATCT
286851 CATTCTGATT AGTATTATAA TTGTAAAGTT CTTTTAGTCT TGCTACATAA
286901 ACTATTATTT TAGCCTTCAC ATTTTAAAAG GCTTCAACAT TTTCTCAGGG
286951 AACATCTGCA GGAAAACAAT ACTTTGGGAG ACAGGAAAAG AAAAGAGGAA
287001 AACTAAACTG CTGAAATGTT AAAGAGTGTA GCCTTTATTA AATAAATGTG
287051 ATGTAACAAA ATGTGTAAAG GACTTTGGGT AAGGAAACCG GATTTCAGGG
287101 TCTGACTTGC CTACTGGGTG TATGATATCT TGAGTAAGGT AACCTATAAT
287151 TTGGAAGTTT TAGTTTTCTT ATCTTTAAGA TGGAGAGAAA AATGATCCCC
287201 ATCGCCTATG ATTAGTGTAA GATTTAAAAA TTGAATAAGA GAAAAGGGCT
287251 GCCATTAAAA GTAGTAAATA CGGAAAACTG GCAATCTGTT TTTAATTGAA
287301 ACTATTTTCA ACAAAAGTAA AAATTTTAAT GAAAGAAGCG TAATATTGTT
287351 AAAAAGCATC CTGACTTTTT AATGATCGCC ATTCTAACTG GTATGAGATG
287401 GTATCTCATT GTGGTTTTGG AACTGAACAA TAAGAACACT TGGACACAGG
287451 AAGGGGAACA TCACACACTG GGGCCTGTCA TGGGGTAGGG GGAAAAGGGA
287501 GGGATAGCAT TAGGAGATAT ACCTAATGTA AATGATGAGT TAATGAGTGC
287551 AGCACACCAA CATGGCACAT GTATACATAT GTAACAAACT GCACCTTGTG
287601 CACATGTACC CTAGAACTTC AAGTATAATG ATAAAAAAAA GCATCCTGCT
287651 TTCTTTTGTT GTGACCATAC CCCCCACCTT CCTTTTCAAA ATTATGTGGC
287701 ACAGGCTGAT AATGCTTACC ATTATTCAAA CACTCATCAG ACTAATGAAA
287751 TTCCTGATTT TTAGGTGGGC TAATGGCTAC TTAAAAATAA TGACCACATT
287801 TCCTACCCTG CTTTTAAGTG ATGTGTGGCC ATATGACTAA GTATGTGAGG
287851 GAAAGTGGTG TGTGTAACTC TGGGATATAT CCTTAGAGCA GTAGTTCACA
287901 AACTTTGTTG TGTACCATCA TCACTTGAAG GACTTGTTAA AAAATAAAAA
287951 AAAAAACAAG CAAACAAAAA AACATATGAT TGAATTCCAT CCTGGAGTTT
288001 TAGATCAGTA AGTCTGGAGA GGAGCTTGAG AATTTTCATT TCTAGTAAGT
288051 TCCTAAATGA TGCTGATGCT GCAGCTTAAA TGATATTATA CTTTGAAAAC
288101 CTCTGCTTTC TTGTTTTGTT TTTCTTCCAC TCTAATGCTC AGAACATGAA
288151 TGTGATGGCT CAGGATGATT CTAGAACCAA AAGTTTAAGA ACCCTGTCCT
288201 AGGGATGGTG GATAAGACAC ATAGGACTGA GGACCTAATA TGAAATTCAT
288251 TCATATTGAT TAAGTCTTTT TGAGCTGGAA GCAATGGGTT TTGATTTCAT
288301 AATGCTGTAA CTTTTAACTT TGCTCTAACA AAGCTATTTT ATACGTATCC
288351 ACATATATGG AGGAAAATGT ATTTGCAAAA TGTGTATGTG TGTGTTTTAA
288401 CCTAAGGAAA TATATATATA TATACACACA CACACATACA CACACATACA
288451 CACCCACACA CACACACACA CATATATATA CATGTCTATA TCTATATCTA
288501 TATAGTTGAG TGCCGAGCTT TTCATAGGAA ATATGAGTAG TTTAAATATT
288551 TAGAGTAGTT TAGAAGTATA TTATTGTATA GCTATATATT TTAAATCTAT
288601 GAACATTTCA CAGAACTACA TAAATTTGTT CAAGGGTAAT GATTAATAAT
288651 GAGATTTACT GACTTCATAA GTATTGAGAG TACTTGGCTT TCAACCTCAT
288701 GCCTTATGAC TTTTCTAAAC CACTGAATGT ACTCAAAAGA AGAATATAAC
288751 CTGTCATGGG TTATGCCAGC CTGGGCATTT AAAATCTCAG TGAGACATGG
288801 GAGAAAAAAG TCAGTATATT CAGGTGTCTT TTACTCAAAG CTAAAATCAT
288851 TGGTAAACTT TTGCCTATTT TATGTGATTC TTAAATTTTC TTAAGTTTTG
288901 AATAATAAGG AGTGGTTTTA ATAATAAAAA TGTCACTTTT ATTTAAAGTT
288951 AAAAACCAAA AGTTAGTGCT TAATACAATA TAAGGGCTAT AGTATAATCT

FIGURE 3GGGG

289001 TTTTTTATAT TCAAATTTAG ATCTATGGAC AGCAAAAGAC ATATGTCAAA
289051 TAAAGTCTAT CATCTGTTAA AAAACTTTCT AAATTATAAG TAACTCAGTG
289101 TTAAATGCCC ACATCTCCTA ATGTTTCCTC CATTTTAGTT CCCTACGTAG
289151 TTTATGAGTT CGTAAACATT TATTTAAATA AAAATTCAAA TTCCAAAACA
289201 AAAAAATCCA ATTGGGGGTC ATTTCATTAA TGTTTATCAT TAAAGCAGTA
289251 ATATTATGAT ATTATGAAAA AAAGAAAAAA TGTAGTTTAA GCTGAAAGAA
289301 TTTGAATGTT CCAAACACAA AGAAATAATA AGTATTTAGT AGAGTATTAG
289351 CTTAGCTGAT TTATAAAAAT GACATATGCA ATATCATTAA TAAAAGAAAT
289401 AAAAATATGT AAATGGAAAA TATAAAGAAA AATATTTTTT AAGAAATGAC
289451 ATGAAGAAAA ATTTAAATAA TTGAGCCATC AAGATTGACA ACATTGCTAT
289501 ATTTTGCTTC CTGGCAGTCA GAGCTAACAG ACATAATCAG TTATTTAATT
289551 TATTCTTCCT TTTTTCAGAG ATAAAGGAAA TATACTACCT TGTAAACAAA
289601 ACAAAACAAA ACACAAGGTT TTACATTGAA AGCATTGAAT TTTTAAAATG
289651 GGAAAAACAT ATTGTGAATC TGAAAATATA AGTTGTAGCT GAATGACCCT
289701 TTCAGTGAAG ATAAAATCAC ATTGGTTCTT TTTTTTTTAA ATGGAATAAT
289751 CATATGACAC TTTCATTGTA TAGCTTTATA TAAAAGATAG TTAATTAAAA
289801 TTTATGTCTT CACTGCCAGA TTGGAAGACC TTTTGTATGG AAATGCATGC
289851 CATATCAAGT GTCATATCTG TCTTATGTCA AGCCTGTATC CATAATAGGT
289901 ACAATAAATG TTTTTTAGTA ATTGATGAAA TAACAAAATT TAATGCTAAG
289951 AAATGCTTCC TGGTATTTTA ATCACATAGC AGATAAATCA GAAGAATGTA
290001 TGCAGCTAAT GTATCCAAAA AGAGAAGTCA AGTAGGCAAT GGTTATTAAA
290051 TCACATTTCT GGATGTGAGT AATGATGTGG GTGAGAATAA TATGATTAAC
290101 AATGCCACAG TTCTACTCCT GTCAAATTAA AATTTTGCAA AAATCGTAGA
290151 GAATGAATCT TACGTTTAAG AATTTGAATT TAGAAAACTT AAGTTATGAG
290201 ATAAATGAAC AATAATGGCA CTCACATAAT ATTTACAACA TACCAAGCAC
290251 TCTTCCAGTG CCTCATATGT TGGAATTAAC AAAGTTCTCA CAATGACTTT
290301 TTGGGTGGTA TCATTAATGC TCTCATTTTG TGAATAGCAA TGCGGCATAT
290351 TACACCCAAG GTCATGTAGC TAGCAAGTGC TGGACCCAGG GATTGGACCA
290401 AGTCTGATTC ATGAGTGTAT GCTCTAATCA GGCTTTTATT CTATACTTCT
290451 AAAACATCCA AACAATTCAC TTTATTTTTT GTGTCTGATT ATTTTAAATT
290501 ATTTGCATAT TATTCAATTT CCAGGACTAT TGGAAGTAAT AAACTTAAAT
290551 TTAATTTAAC TTTTGATATG TAGAATTACT GAACTCTGCT TGCTTTTTTA
290601 TGTAAGCTTT CTTATGCATT AGATCTGAAT AGGCAACAGA ATTTATGGGA
290651 GAACCAAAAC CATTCTAGGG AAGATATGGA AAAATAAATT AAAACAGAAG
290701 GATTTGAGTA CATTTTAAAT GTGAATGTGA TGATGTTATG TGACTAAGAT
290751 TTATGAAATG TTATATTATG TGATTATCTT TACCTAACTT ATGATGAAAA
290801 AGTAGTTGAA CCTCTAAGAC TTTTTCAAAA ACCCTTATGA CAAAGAAGTC
290851 AGTAAAGTGG AAAAAGGTAA CACTTTTTGT TATGAATCAA CAAAAATAGG
290901 GGTATCTGGA ACACTTCGTA GTCTGTATTA TAACACTACA ATCCACTATG
290951 TCAATCAAGC AAAAAGGGAT GTAATTGTTA TGCTGCTGTG TCCACAACTG
291001 ATGAATGTTT GTTGCTATTT GATGGTTGGT AACAAATTGG TGGGTTCTGC
291051 TGTCAGCACT GCTATCAGAG TACAGTTCTA TTATATTCTC ATTAACATAA
291101 TGATAAAATT AACATTAAGA AAACACTTTC TATAAGAATT TATGAGATTC
291151 TATGCAATTA AGCATGTAAC AGTGTGGACA GAAAATTTGC AGAAGGCTGT
291201 ATAATAATAA AAACTTTAAA AATATATTTG TAGAAGTAGT CAGTGACCTG
291251 AGACTTTAGA CTGTTGATGA CTGGCTTGTT GATATGTTAA TGTGAAGTAA
291301 TTATTCCAGT GAATTGAAGC TGAAAGTCAA CATGTATATT TATTAATTTA
291351 GTTTAAGCTT CCTTATTGTT AATCACAGTT GAGGTATCTA TTTTCAGCAG
291401 ACTTATCCAT AACTTTCCCA TCAAGGTTTG CCAACCATAA AATCTAAATA
291451 TTTTTTTCCT GTCAACTTTC TAATTTCTAA TTAGGAAATG TTTTGTGACT
291501 CTTTAAAATC CTAAACACTT GTTTGTCTTT AAGAACTGAT TTTGTGGGTC
291551 AGAAATCTGT TAAATATTGC ATATAATTTG TCTTTTGATA TTCACTAATA
291601 TTTTCACAAT ATTTATAAGC ATGTTCAGTT ATTAAAGGAT TAGATATTTC
291651 TTAATAAGTA CCTTTTACTA ATTGTGATAG TGTGTTATGT CAGAAACAAT
291701 ATTATGTGTT TACCAAACCC TCCTTTTTTG GTTTGTGACT CATCCTAATG
291751 AAATTTCCCA GCATATCTTA TCGCCGAGTG GGATCATGTG ACCTGTTTCT
291801 GGATACTGGA ATGTTGATTA AAGTAGAATA TGCCACTTTC TGGTCTTGCT
291851 CATTAAAAGA CCTTCCTGAT TATCTGCCAA GCTCTCTCCA TCTTTCTTCT
291901 CACACCCTGA TGATGAAAAT CCAGTGGAGG ACCCCAAAGC CCTGAAGATA
291951 TGTTGAAGTG TAAGATGGAA GTAACCTAGA TCCTGAATGA TCATATGGAG
292001 CAAAGTCCCA CAGCTGACTA CTTTGGATTA TGAAGTGAGT GAGAAATAAA
292051 CCTGTAGTGT TTACACTAAT GAGACTTTCT GAGTTTTTGT TATTGCTGTT
292101 AGTCTACCTT GACCAATAGA TTTGTGCTTA GCACAAAATT GGAAGTTGGA
292151 GAAAATTAAA AACAAAGGAG TGTCTCCACC ATGTGTATGT GTATTTTTGT
292201 AGATAGCAAG TTAAAAGTCA CTATACAAGG CCACAGTTTA TTTGGGTACT
292251 ATTGTATTGG CCAAAGCAAC TCTACTATGA ATGCAGGAGG AACTAGCAAA
292301 ACAAAGTTAA TAAAGAGAAG CTGTTCTTCA CTTCAAAATT TAATTTCATG
292351 TCTCTAATCA TAATAGAATA AGAAATGCAG TCACCTAGAG ATCAAAGCAC

FIGURE 3HHHH

292401 ACAATAAATA TAGTTTATAT ATATCTATAT ATTTTATATA TATATAGATA
292451 TATGGAGCTT AACATTCTCT AAGCAGTTTT GATGACACAA TAGTAAAGAG
292501 ATCAGTTTTT AATGCAATAC TATATATTTC TTTCTGATTA TCAGGCAGAC
292551 AAATTAACAA AGAGACATAA TAATAACAAT CATATTTTGA GTGTTTCTCA
292601 GGTGCAACCA TAATTTGGGA CCCTATTATA TACATTATTC TACTTAATGG
292651 CTACTAACTG ATTTTAGAGA TATTAAACAA AATCAGAGAG GCTAATTTGC
292701 CCACATCATG TAGCTCTTTA GTACTAAGAC TGAGATTCAT CCCTAGGCCC
292751 AGCCTACTTT CAGAGATAAT ACACTGTTCA TTGTGTGAGC AGAGAATGGA
292801 GTTAGTAAGT TAAGTAGGAA CAAGACAGGA TAACTGGGAT AACTGAAGGT
292851 ACGTGTTCCA AATATTTTTC CTTTATTTTA AAAAGTTGAA ATACATTTCA
292901 GTTACTCTGA ACATTATCAA AGTGATATAC CAAGTGTTTC CTATTATTTC
292951 CCATTTTCAC TTGTTTGGGC TAAAATGTCT GTATATTTTT GACATTATTG
293001 TTGTAATTTT TTCTACATAT TCTATCCTAA TATTAACCAC TCCCTGAATA
293051 TTGTGCTGGA GAAGGTAGTG AGATTTTAAA ATAATCATAA ATGAGAATAA
293101 GATAAATGAT TAAAACAGCA TCTCTATTAC AGAATGAAAT AAAGATTATC
293151 AATAAAGTCT ATAATTATTT GATAATGGAG TTTAGTATCT GTGAATGTAA
293201 AACGACTTTA TAATGTATTA TGATTCAGAT TTTCAACTTA AGGCACATTG
293251 TCTCTGATCT GTCATTTTTT ACTGTGGTGA GTAAATTATC ATAACTATAT
293301 TTTTGGTCAA TTCAAGCTTT TACAGTAAAT TTTGAACATA TAAATTATTT
293351 AATACAGGAA TAGGGAAAAT GAATCCAATA CTCAGAAATA AAAATGAATT
293401 AATTAGAACA TATTAGAAGT GAGCTTTGCA GATATCTATT CTAACCACTT
293451 CATTTTACAA AGGAAGATTC AGAGACATTG AGTGGCTTTT CTAAAATGTC
293501 ACTGATAGGA TGAACTCAAC TACAAAATCT AGTTCCTTTG TCCCCATGAT
293551 ATGCCCGCTC TCTCCAATTT GTTGTTTGTG TGTACTGTGT GGCCACTGCA
293601 TACCTTTGAG TGACTTTATT TAATTTCCAA ATAAGTTATA ATGGATATTT
293651 GACTGGGTGT CATGTTGTTC ATGTGGGAAT AACCCAAAAG GCCCAGTGTG
293701 TCTCCTCTAA ATGCCCATTT GGAGTTCCTG TTCATCCCTG ATTCATTTAA
293751 GCAAGTTTTT CTGTTTGGGC CAGATTCTAG CCTCCAATGT CAGGGATACA
293801 CCTGAGCACT GAGAAACTTC TTGAAGGTGT AACTTTACTT TTAGGTTTCT
293851 GTTTAGTAAG ATCTAAATAG ACATTTTACT TTTTGGAAAT ATGTGGATTA
293901 TCAAACTCTA AAATTCTTTA CAACATGACA CTTTGATATT TACAAAATCT
293951 TCCTGAGTTT AATGCAAAAG ATTGATTAAA TATCTTCTTA TTTTAATTTT
294001 ATTTTTGTTG GATTGTAGTT CTTTTATCAG ACAGATCTGT ATTCAGTTTC
294051 AGCTCTGCCA CTTACTATTT TGACTATTCA TTGACAAATA TCTTAACTAC
294101 TCTAAATTTC AGTTTCCTCC CAAATGATAA GGAAACATCT CCCTGCTAGA
294151 ACTCTTTATC CAAATTGTTT GGCCTATCAA CTTACTCGAT CAGTGAAACT
294201 TGCCAGAGGT GACATCTGGG ACTTTGATGG CTAGGTCATC AGAAGCCTTG
294251 CCCCTTTTCT CTGGACTTCT TGGTACTCAG ACACTCTCTG GAGGCACTGA
294301 GCCGCCATAT AAGAAACACT CATAGCTTGT GAGCTGCATG TTGGAGAGCC
294351 ACATTTAGGT AATCTATCTC CAGTATCTGA TGAGTCCTTT CTTCCAACCA
294401 TCCTCAGGAA GACACCAAAC GTATGAGTGA AGCAATCTTG GATTCTCTAT
294451 CCCAGACTGT CCATATCAGA CACAGAGTGA TCTTAGTAAA TGCTACGTGG
294501 AGCAAAGCAT TGTTCAGCTG AGTCCTAACC AAACTCCTGA CCTACAGAAC
294551 TGCGAGATAC AATAAAATTA TTGTTATTTT AACCCATTAA ATGTGGGTAG
294601 GGGGATAGTG TATGACAACA ACATTTAGGT TGAAAAAATA TTCCTAAGGC
294651 CCAATATATT GTAAATTTAA TGAAGAGCTG TTAAAGGATA CAAACATCCA
294701 ATTATGTACA AATACGATTA AACTTCTGTG CTTTTGCTAT TGTGAATAGT
294751 GCTGCAATGA AAATATACGT GCATGTGCCT TCATAGTAAA TGATTTATGC
294801 TCTTTTGGGT ATATACCCAG TAATGGGATT GCTGGGTTAA ATGGTAGTTC
294851 TGTTTTTAGC TTTTTGAGGA ATCACCATGC TGTTTTCCTC AATAGTTGAA
294901 CTAATTTACA CCCCCACCAG CAAAGTATAA GCATTTCCTT TTCTCCACAA
294951 CCTTGCCAGC ATCTGTTATC TTTTTTTTTG GCTTTTTAGT AATAGCCATT
295001 CTGACTCATG TGAGTTGGTA TCTCATTGTG GTTTTGGTTT GCATTTCTCT
295051 AATGATCCAT GATATTGAGC TTTTATTCAT TTGCTTTTTG GCCACATGCA
295101 TGTCTTCCTT TGAAAAGTAT CTGTTTATTT ATGTCCTTTA CCTAATTTTT
295151 AATAGGATCT TTTTGTCTTG TAAATTTATT TATGTTTCTT ATAGATGCTA
295201 GATATTACAT CTTTGTCAGA GGCACAGTGT GCAGAAATTT TCTTCCATTC
295251 TGTAGGTTGT CTGTTTACTT ACTCTATTGA TAGTTTCTTT TGCTGTGCAG
295301 AAGCTCCTTA GTTTAATTTG GTCCCATTTG TCAATCTTTG CTTTTTTGTG
295351 ATTGCTTTTG GCATATTTGT CATTAAATCT TTGCCCATTC CTATGGTATT
295401 TACCATCCAG AATGGTATTT CCTAGGTTGC CTTTCACAGT TTTCATAGTT
295451 CGAGGTTTTA CATTAAAGTC TTTAATCTAT CTTGAGTTGA TTTTTGTATA
295501 TAGTGTAGGG AGGGGATCCA GTTGCAATCT TATGCCTATG GCTAGCCAGT
295551 TATCCCAGCA CCATTTACTG AATAGGGAGT TCTTTCCCCA TTGCCTGTTT
295601 CTGTCACCTT TGTCAAAGAT CAGATGGTTG CATGTGACAT TATTTCTGGT
295651 TTGTTTATCC TATTCCATTG GTCTATGTGT CTGTTGTTGT ACCAGTACCA
295701 TGCTGTTTTG GTTAATGTAG CCCTGTAGTA TAGGTTGAAG TCGGGTTATA
295751 TGATGCCTCC AGCTTTGTTC TTTTTGCTTA GAATTTCCTT GGCTATTTGG

FIGURE 3IIII

```
295801 GCTCTTTTTT GGTTCCATAT AAATATTAAA ATAGTTTTGT TGTTGTTATT
295851 GTTGTTCTGT GAAAATGTCA TTGGGAGTTT GATAGGAATC GCACTGAATC
295901 TGTAAATTGC TTTGAGCAGT ATGGGCATTT TAACAATTTT GATTTCTCCT
295951 ATACATGATC ATGGAACGTT TTCCATTTTT TTGTTTCATC TCTGGTTTCT
296001 TTGAGCAGTG TTTTGTAGTT CTCCTTGTAG AGCTTTTTCA CCTCCCTGGT
296051 TAGCTGTATG CCTAGGTATT TTTTTCTTTT GAGGGTAATT GTGAATGTGT
296101 TTTAATTCCT GATTTGGCTC TCAGCTTGGC TATTATTGAT ATATAGGAAT
296151 GCTTGTCACT TTAATACATT GATTTTGTAT CCTGAAACTT TGCTGAAGTT
296201 GTTTATCAGC TGAAGGAACT TTGGGGCCAA GGCTATGGGG TTTTCTAGTA
296251 TATGGAATCA TGTCATCTGA AAACAGGTAT ATTTTAACCT CCTCTCTTCC
296301 TATTTGGTTG CCCTTTATTT CTTTCTCTTG CCTGATTGCT CTAGCCAGGA
296351 CTTACAATAC TGTGTTGAAT AGGAGTGGTG AGAGAGGACA TCCCTGTCTT
296401 ACGCCCTTTT CAAATATAAT GCTTCCAGCG TTTGCCCATT CCATAGGATG
296451 TTGGCTGCAA GTTTGTCATA GAAGGCTCTT ACTATTTCGT GATATGTTTC
296501 TTCAATACCT AGTTTGCTGA GAGTTTTAAC AAGAAGCGAT GTTTAATTTT
296551 ATCAAAAGCC TTTTCTGCAT CTATTGAGAT AATCATGTGG TTTTTTTCTT
296601 TAGTTCTGTT TATATGATTA ATCATATTTA TTTATTTTCG TATGTTGAAC
296651 CAAACTTGCA TCCCAGGGAT GAAGCCTACT TGATCGTGGT GGATAAGCTT
296701 TTTGATGTGC TACTGGATTC AGTTTGCAAG TATTTAGTTG AGGATTTTTG
296751 CGTCAATGTT TATCAAGGAT ATTGGCCTGA AGCTTTCTTT TTTCATCATG
296801 TCTCTGCTAG GTTTTGATAT TGGGATGATG CTGGCCTCAT TGAATTAGTT
296851 GAGAAATCCT TCCGCCTCAA TTTTTGGTAA CAATTTCAGT AGGAATGGTA
296901 TCAGCTCTTC TTTGTACATC AGGTAGAATC CAGCTGTGAA TCTGTTTGGT
296951 CTTGGGCTTT TTTTGGTTGG TAGCTAATTA TTACGAATTC AGTTTCAGAG
297001 ATCTGTTATT GATCTGTTCA GGGAATCAGT TGCTTCCTGC TTCAATCTTG
297051 GCAGGGTGTA TGTGTCCAGG AATTCATCTG TCTCATCTAG GTTTTCCTGT
297101 TTGTGTGCAT AAATGTGTTG GTAGTAGTCT CTGATGCTTG CTTGTATTTN
297151 NNNNNNNNNN NNNNNNNNNN NNNNNNNNNN NNNNNNNNNN NNNNNNNNNN
297201 NNNNNNNNNN NNNNNNNNNN NNNNNNNNNN NNNNNNNNNN NNNNNNNNNN
297251 NNNNNNNNNN NNNNNNNNNN NNNNNNNNNN NNNNNNNNNN NNNNNNNNNN
297301 NNNNNNNNNN NNNNNNNNNN NNNNNNNNNN NNNNNNNNNN NNNNNNNNNN
297351 NNNNNNNNNN NNNNNNNNNN NNNNNNNNNN NNNNNNNNNN NNNNNNNNNN
297401 NNNNNNNNNN NNNNNNNNNN NNNNNNNNNN NNNNNNNNNN NNNNNNNNNN
297451 NNNNNNNNNN NNNNNNNNNN NNNNNNNNNN NNNNNNNNNN NNNNNNNNNN
297501 NNNNNNNNNN NNNNNNNNNN NNNNNNNNNN NNNNNNNNNN NNNNNNNNNN
297551 NNNNNNNNNN NNNNNNNNNN NNNNNNNNNN NNNNNNNNNN NNNNNNNNNN
297601 NNNNNNNNNN NNNNNNNNNN NNNNNNNNNN NNNNNNNNNN NNNNNNNNNN
297651 NNNNNNNNNN NNNNNNNNNN NNNNNNNNNN NNNNNNNNNN NNNNNNNNNN
297701 NNNNNNNNNN NNNNNNNNNN NNNNNNNNNN NNNNNNNNNN NNNNNNNNNN
297751 NNNNNNNNNN NNNNNNNNNN NNNNNNNNNN NNNNNNNNNN NNNNNNNNNN
297801 NNNNNNNNNN NNNNNNNNNN NNNNNNNNNN NNNNNNNNNN NNNNNNNNNN
297851 NNNNNNNNNN NNNNNNNNNN NNNNNNNNNN NNNNNNNNNN NNNNNNNNNN
297901 NNNNNNNNNN NNNNNNNNNN NNNNNNNNNN NNNNNNNNNN NNNNNNNNNN
297951 NNNNNNNNNN NNNNNNNNNN NNNNNNNNNN NNNNNNNNNN NNNNNNNNNN
298001 NNNNNNNNNN NNNNNNNNNN NNNNNNNNNN NNNNNNNNNN NNNNNNNNNN
298051 NNNNNNNNNN NNNNNNNNNN NNNNNNNNNN NNNNNNNNNN NNNNNNNNNN
298101 NNNNNNNNNN NNNNNNNNNN NNNNNNNNNN NNNNNNNNNN NNNNNNNNNN
298151 NNNNNNNNNN NNNNNNNNNN NNNNNNNNNN NNNNNNNNNN NNNNNNNNNN
298201 NNNNNNNNNN NNNNNNNNNN NNNNNNNNNN NNNNNNNNNN NNNNNNNNNN
298251 NNNNNNNNNN NNNNNNNNNN NNNNNNNNNN NNNNNNNNNN NNNNNNNNNN
298301 NNNNNNNNNN NNNNNNNNNN NNNNNNNNNN NNNNNNNNNN NNNNNNNNNN
298351 NNNNNNNNNN NNNNNNNNNN NNNNNNNNNN NNNNNNNNNN NNNNNNNNNN
298401 NNNNNNNNNN NNNNNNNNNN NNNNNNNNNN NNNNNNNNNN NNNNNNNNNN
298451 NNNNNNNNNN NNNNNNNNNN NNNNNNNNNN NNNNNNNNNN NNNNNNNNNN
298501 NNNNNNNNNN NNNNNNNNNN NNNNNNNNNN NNNNNNCAGG GGAAAACAAC
298551 TTTCCTGCTC CATCCCCCTT CTGGCTTCCC CATCTGCTGA GAGCTACTTT
298601 TACTCAGTAA AACGTTGTAC TCATTTTCCA AGCCCACTTG TGATCTAATT
298651 CTTCCGGTAC ACCAAGGTGA GAAACCCCAG GATACAGAAA GCCCTCTGTC
298701 CTTGTGATAA GGCAGAGGGT CTAACTGAGC TGACTGAGAC AAGCCATCTA
298751 CTGATGGCTA AACTAAAAGA GCACCCTGTA ACACAGGCTC ACTGAGACTT
298801 ACTGCCGAGG GGTCGGAGCC CCAAAACCTG CCTGTATGCC TGCGCTCCCT
298851 AGGGGTTTTG AGCAGTGGGG CACTGAAGGC AAGCTACACT CCCATCACAT
298901 GCCTTGCAAG GAGGATAAGG AAATTTTTCT CATTTCAATA ACTTATCAAG
298951 TGTATAGAGA AAGGAACGAC AACTATTCAG GTGTCTGGGA TCAGAGTGTT
299001 CCAGTTTGAC TTGGTGATGG TGGGGTTACC AAAGAAACAA GTATAGAAAA
299051 TTCACCATTC TTGTATCTTC CAATCGGCCA GGATCCTTGA TCATTATAGG
299101 TATTTAAAGG TTGAATGAAT GGTTGAATAA AAGCATTAGT CTCCTACTAT
299151 TACTACTTTG CAGGTTTCTA TATAGATTAA TATTTTAATT TTATATATGG
```

FIGURE 3JJJJ

299201 GCATTTACAA TAAGTAAATG TAATTTACTT TGTAATTTAC ATTACAAAAG
299251 TGATGTTTTC ATTGAGCAGT ATTTTATACT GGGAGAAAAA TCTGCCTGAA
299301 TATTCAAGAA GTAAATAGTA GTGAGAAGAG CTGTTTGCAT TTTCATCGGC
299351 CTTCTTAAAC TAGCTTTATA CCTGGGGTCC CTGCTTTTAT TCCTACTCCC
299401 TTTCATAACC GAGTCATCCT GGATGACAAT GTCTGTTTAT ACTTTTGTTA
299451 TACATCACTT TTCCTCATTT CATTTCTTGG TTGAAGACCA TATGTTGTTT
299501 CCTGTTGCTT ACTGGACTGA GTCTGTACTT ATCTACTTTT ATTAAAAAGT
299551 CTTTCATAAG CTAAGCCTGT TTTCTCTAAC TTCCATGAAG ATAGCTATTC
299601 GTAACTGACT AATTTCTAAC TTCTAACTAA GTTATTTCTA ACTTCATGCT
299651 TGTCCCCTAT ACAAAGTGTT TTATCCCTTG TTTGCATGTT TTTAATGTTG
299701 TTTCTATTTG TAATGTACAT CTCCAATCTT TTTCAGAGTC TATTTCATGT
299751 CCATGTCTTC TATTAGAATT TACTTGATTC TGATGTATTA GGGAGGCTGA
299801 ATTTCTAGAG AATAAATATA GCATATGCCA CATTATTTAT CATTTTTGTA
299851 AATGTTACAT TTTGTCATTC CTCATTGTTT TTCTGCATTT TATTTCCTCA
299901 AATAGATTTT TAAGTTATTT CAGCCTAAGG ATCTCATTGT AGTTTTAAAG
299951 TGAAATTATG TGTTATATAG CTTAGATATT TTAAAGCAAT TATTCTTGGG
300001 TTTTCAAATG AAACTACATG ATACTATTCT AAGTGCTAGA ATTGTTATTG
300051 TATATAAGGG ACCTAAGTTA CTCTCACTAA GTTTGGCCTC CTTCAAAACA
300101 TAGCAGGATA CCTTTTCTTA TCCCTGAGAC CTTTATAATT CTAGCTGGTA
300151 CTTTCCAAAT CATGCAGTGC CAACACAGGT AAATTGCATA CTAGGTAGAA
300201 GCTGTCAGGA TGTTACCCAC CACAGGAAGT AGTAGAGAAA GAGTGTTAGG
300251 GGAAAGTCAG TGGAAAGCTC AGTAAGAAAA GGAACACATG AAAACAATAT
300301 GCTGGTTATT ATCAATAGTT AAAACCAACT GGATAGCAAG TGTTCCCATT
300351 TAAAATCAAT CAATGGATGC CAAAATAGCT TAGTCAGCAT GAACCATTGA
300401 TATTTGCAGA TTTCATTCAT TCCAGCCCTG GTATGGGATT GGACAGAAAA
300451 CAACACAGAA TGAGCTGCAG CAAATGGCAC AATCTTTATT GCATTATATA
300501 CCCTATATGC CTATTTCTTC AAAGTACAAG GCATTGCCAA GGAAAGTACA
300551 TAAGAAAAGA ACACAATACT TACGTCAAAA TGTTTGTGTA ATGCTTCATT
300601 ATGTGACATT ACAAAGTCAT GAGATCTAAG AGATGAAGGG ACGATTTTTC
300651 AGTGACCCAC TCCATATGCT TCTGGCAGAA GCTACTGCTT GAGAAGATAC
300701 AGGCAGAAAA TTCATCATCT TACAAGGTAG CCTATCTCAT TTTTAATAGC
300751 TTTATTCTGG TGGACAAGGT AAACATTAAC AAGCTAGGAC ATTTCTGGCA
300801 CTGCTGTCAT TCTCTTTGGG ACCTTGACCT CACTTCCAAA TACTTCCAGT
300851 TATTATTGAG AATTTTCAGG TGTTAACATG TGTTCTAATG ATTATAGTTT
300901 ACAGCTACAG TGTTGCAGTC AACATTTACC ATTCTTGCTC CAGCTTTCCA
300951 TGTAGATGTT CAAAGCTATG GTGGACATCA AATGTTGCAG CCATTCCAGT
301001 GGCATGTACA ACACTCCAGG GACTGAGCAG AGGGCAGCCA GAGTGACAGA
301051 TGGCAGGCTA CACTCATAAC CACCTCTGTA TTCTATTGCA CTTGCAACAA
301101 TCTTTTGATG TTATTGATTT CTTGCCAAGT TTTTCCTATT AATGTAAGAT
301151 GCTTGAGAGA AAGAACCATG ATTTATTTGA TTCGGGTTAT AAATATTTTT
301201 GAATGAATGA GTGATTTTAA GCATTCATCC ACAGCTCAAA CTATGCAATA
301251 ATCACTTTCC TTTCAGTGAG TTCTTTACCT AGAGCAGACT GCCTTGTAAA
301301 ACATGTAAAT GGACCTCTCA CAGTCTAACT TTTTATAGAC ATGCATGACC
301351 CAAATTTAGG GTGAAGACTG TTTAGGCTTA AGGTGTAATA CTTGCTGGAT
301401 TCATAAGTTA GTGTTGTTAT GAAACACAAC TGTCTCTCAT GGGCCTAGTT
301451 CAGCCCAGTG GAACTAAATA GAATAAATCT TTTCTACTTG CATGGGAAGG
301501 AGAGTTGTGT TAAGGATTTA TAGCTTCATG AAGACTTTCA AGTTAAATTT
301551 TAAAGAAACT TGAATAAAGC AACTGTCAGT AACTGTTGCT TGGAGTGAAA
301601 AGTGAAGACG CTAAGAGCTG CTACTTTTTC AGCTTTTATA AAGTACAGAG
301651 TTGTTTTTGT GCTGGAAGCA GGAAGCTAGG AGCAGCACGG TGAGAAGCAC
301701 AAAACTCCGA GATGGAGATG TCAAGAAGAT GTGCAGTATT CATTTATTCA
301751 TTAACTGCAG AATATTTACT GACCAACGAC AATGTACTAT GACAGATGCT
301801 GACAGCAGTA AACAAGATGG ACAGAGGCTC CTGACCTTAT GAAGATATGG
301851 CCTAGCAGAG GATAGACAGA AGGTTACACT TATTCAAATC ACTAATGGTA
301901 ATTGTGACAA GTACAGAAGT GATCATATGG TAACCTAACA ATTTCCACCA
301951 AAATAATCAC CGGGATTAGA AGGGCTGGGT TATATGGGAG GCATCATATC
302001 AAGAAGCATT TCATTTTCTA TTGATTTAAT GAAATCAATA GAAATGAGAA
302051 TGAAAAGAGG TATTAAATAA CATTGAAATA CTCTTTTCTA CATTTCTTGC
302101 CACTTGGAGA ATAAAAGGGT AAATTAACTT TTCAAAAAAA TCTTCAGCTA
302151 TATGGTTTAG ATACTTTGCA TATTCATTGC ATTTTAACAC CATTCTGTGA
302201 AAAAGATGAA ATTATTTTCA TTCATAGGGA TAAAGTGACT AAAATACTTG
302251 TAGATGGGGG TGGATGATGG GCACAAATTA CTTAAACATG GTAATGATAG
302301 GGCCTCCATA ATGGTAATTT ACCATTTACA TAACTCTCTT TTAGGAGAAA
302351 TTTCAGGTAC CAGCCCAGAG TCGTACAGCT AAATGGCAGT CAGAAATCAA
302401 ACTCAGCTCT GTTTGATTGT TGTGTCTGAT TCACTTTCAT TTTAAAAACT
302451 ATTTTTCTTG CCAAATCACA TTGTTCTAGG ATTTCATTTA TTATGATTAT
302501 TTTTGTTATT GTTTTAATTT AGGAACTCAG AAATGTTAGA TTGCCAGTAT
302551 AACTCCTTCA TTTTATTATA TTATTTATTT ATTTATTTAG AGACAGAGTC

FIGURE 3KKKK

302601 TCACTCTGTT GCCCAGGCTG GAGTGCAGTG GTGCAATCTC TGTTCACTGC
302651 AGCCTCTGTC TCCAGGGTTC AAGCGATCCT CCCTCCTCAG CCTCCCAAGT
302701 AGCTGGGATT ACAAGCATGT GCCACCACAC CCAGATAATT TTTGTATTTT
302751 TTTTTAGTAG AGATGGGATT TCACCATGTT GGCCAGGCTG GTCTCAAACT
302801 CCTCACCTCA AGTGATCCAC CTGCCTTGGT CTCCCAAATT GCTGGGGTTA
302851 TAGGTGTGAG CCACCATGCC TGGCCATCTT TCATTTTAAA AAGGAAAAAC
302901 TTGGAATTCA GAGAGTTAAT GTGACTTGCT CAGAATTTTA CAGAAATTAG
302951 ACCCAAGTTG TCAAAATTTG CAGGAAGTAC TACAAAATAT GTGATTATTA
303001 CCTATACTAA TATTTAAATA GTTTATATCC TAGTGAAAGG CAATATTTTT
303051 CTTAGAAATT TTTTCACTAT AGGGCTTTAG GAAAAGGTTT AAAAAGAGCT
303101 TTACATATGA AAATGATACT GCCTAGTGAG CATCCTCAAC TCAGCAAAAC
303151 TCTCCCAAAC TCAGCCAGGG ATTAAAAGCT CTGACTTACA CACCTAAGAT
303201 GTTTTCATCA TGTACAGACT TAGAGGTTAT TTTCAACAAC AACAGTAATT
303251 AACTTACAAA TGTGGAATTT TCTTATAAAA AATTTGGCTT TTATTCATGA
303301 ATTTCTTCAT TGCATATTAT AAAATATATC CACTGAATTG AGTTTTTGAG
303351 ATCTATTATT GTGGTGTTCA TTTATTGTGT GAATTTTTTT TGCAATTGTA
303401 TTTGACATGT ACCTGGTTAA GTACTTGTTT TCAGCTTTTA GCATAATAAG
303451 CAATATGTGC TATCATAGCT TCAATTTTCC TGCCAAGTAG AGAGTGACAG
303501 CTGTGTGGCA ATATCTAATG CATATTTTCA TCTACAGATA AATTGGAAGG
303551 AAGGAAAAAC AGCTTCTGGG TGGGCAGGTC ACCATCATTT AAATGAATCG
303601 TTAAAATTAT ATTTTTCCCT GGAAACAAAA TGTAATTGCT TTTCTGCTTA
303651 GATGCACACT GAAAGCCCTT ATTTATATTA TTGTAACATA TTTTCTCACA
303701 ATTTACAACT TTCTCAAGAT CCTTTGGATT TTTTTCATTT TTGTTACTTT
303751 CCTCCATTCA AGCAATGTAC ACTTATATCT TAATAAAGCT TTGTGATATT
303801 TACATAAATT TATTCCTGAA GGACATTGTT CAATACTCTT CCACATTCAT
303851 TTGACGGCAC TGAAGCAATT AAAGCCCTAC ATTGATTGCC ACTTCAGGAA
303901 CGTTCTCATG CTCACCTTGA ATGCAGAAAG GTTACAGCCT TGGGCTCAGT
303951 ATTTTTAATG TGCAATATTT TTACTAAATT TCAAAGAAAT AAGAAATATT
304001 ATTTATCTCT TTTTTCATTT TGTAATTTTA GATTTTGCCA CTAATTGTAA
304051 GACATTTGCC CATCTCCAAG ATAGCATGAA TACATTCACT GTGTTTCCAA
304101 ATTGTGTTGC TGCCTACAAC TTAAAATTAT CTTAACAATG ATTCATGTAG
304151 TAATATGAGG TTCATAAAGA TATAGTATTC ATTTAATGAT TTGCATAAAT
304201 AAAAAACAAA GACAATTTTC ATCTCTGTTT CTTCTGCTCT CAATTTGCTT
304251 GTATATAAGT GATAATTTGG TATTTTATGT GCTGGTATGC CTTTATTTTG
304301 AGACGTTCAA AAGGTTAGCA TGGGATAGTA ATTTATGTGA AAGCTGTCAC
304351 TTATTAAAAC AGTACAACCA TTCATGAGTT CTGTGATACT CTGAGTAAAT
304401 CTAATTCCAC TTTAGACTTT GATGATGTTA TTTGCAATTA AAGATTCTAT
304451 CTCTGGTGAT TATTACTACA ATATTTTGGC TTATCTGACC AATCACAAAC
304501 TTGAGGACAT TAGAGAGGGG AAGAAAAGCC AAGTGCTATT TTTCTAGAGT
304551 TTACTTAGGG TTTAAAAATT TTGTTGTTTC AAAGGTGATA GTTTCTGTTG
304601 TATCATAAGC ACATGAAGAA AGTCGATTTT GTATGTGAAG TTTAATCAGC
304651 ATAGCCTAAG TTTCTGTCTG AAATGATACA CTATGAGTGG TTTTTTTTTT
304701 CTAGCCTAGT ATGATTTAAT GAAAATTTTA GACTATTTTT TGCCCAAGCA
304751 ATATTTCTTA GGTCTTCGTT CAGAGGATTC ATATATGGAT CTGTGTCTAT
304801 TGCTAATAGG CTTCTTAATG TATACTCCTT TTAGTTTTTT CCTCCTCTTG
304851 AACTTTGTAC CATACAGCTA GTATCACTGT CTCACCTAAA TCATTGTTAT
304901 TACCAGTAAG TGATAGGATA GTCTCTAAAT TTCCTTGATA ACTCAGGTAT
304951 TTCCTTAATA ACTCAGAATC ATTGTTTTTC TATCAGGTCA TGTTTGTGAA
305001 CCTAAGAGTT CAACACTCAC TTGTTTTTTC TAATTTATTG TCCTTATACT
305051 TCTAGCATAC TTGACTTGTT TTTAGTTACT CATTTCACAG ATATTAGTTG
305101 GAGTCTCTGC TATGTGTCAG GCCCTCAACT CAACTGCTTC AGCTGCCCTC
305151 AGGCTCAACC TTGTCCTGTA GATAATCATT TCCCCGACTG GTCATATTTC
305201 TGAGTTATTA CATTCTGAAA ATTACCTATA TTACCATTGT CTTCACTGTG
305251 ATTTATACTG TTTTAGATCA GATTCCTTGG GAAATAGACC CTTAACCAGG
305301 ATTTGCATTC AAGAAACTTA CTGGGAAATC CTCTAGTGAA TAACATCTGT
305351 GAGGGAGTAA AAGCCATGTA ACTGAGCAGA GTGAGATGCA GAATTGAGAT
305401 GCAGTTGCCA AAAAAGACTT TACCCATCCT CCACAGATTG CTGTGAAGCT
305451 AAATGGCAGT TCAGAAATGT TCCTAACTGA GGCAAGGAAG GAGCCTAACT
305501 GGCTCCTTTC GTCGACAAGT CATAGTTGTG GGCTACAGGC TCCACCTTGT
305551 GTGAACAGCC CCCACTTTGG TCAAGGGCAA GGCCTAAGGA AATACTCAGC
305601 TTTGTGTCAT CAGCAGGCAA CACTCTTTGC AGCTGAAATA ATGAAGGCCT
305651 GCATCCCCAA AGGGAGAACT GGGTGGCATA CCAGAGCACC CACAAAAAAA
305701 AGTCTTTCTT GCCTTTTTCC TTTTTTCATC CAGAAGTAAC ATTTTTTACT
305751 TCTCTCTCTC CCTCCTTCTC TCTCTCTGCC TTCCTTCCCC ATAAAGGCTA
305801 TATTGATTGC ATTTGTCATT GTCATGTAAA GAGTTCTTTC AAAAATTGCC
305851 TAGTAGCAAG AATGTCCCAC AGACTTTTTT CTTATAATTC AGCTATAAGG
305901 AAAAGAAAAA CAAAAACAAT ATTTTATGCA TATCTAGTGT TATGAGAGAT
305951 ATAGTGAGGA ATTTGATCAC TTTTATAGAT TAAGTCTAGT CATTTCCTGT

FIGURE 3LLLL

306001 CCTGAATTAC AGCAGAAATA TTACTAGCTT TGCTTGGGGT ATCTTGGGAT
306051 AGATGGCCAG TTCCTGATCA CGAGGAGGAG GTGGTTACTA CCTCTACCAT
306101 AACATGCTGC TGCTATTATG CTATTCATCA GAATACAACA GTAAAAACTG
306151 GATTTAGCAG AAGTAGTGGT ATCACAGAGG AGCCCCTTGG TGAACAAGAC
306201 CTCTTCTTCT TTATACTTCC AATCATGCCG TTTTAAATGC TAACCACATT
306251 TAGGAGAGCT TTCCACATGA AAGACTTCTA ATAATATTTA AGTTTTGTTT
306301 ACATAAAAAT ACAACTGAAC ATTTTTATAG AAATTTAGTA ACAACAAATT
306351 ACTACTTTAT AAATTGTAAT AATTTCTTAT ATTTAAGGAC TTTTAATTTC
306401 ACCAGCAAAT ATGGCTAAAT TTACTGTATC ATTAGAGTTA CTTGGTTAAG
306451 TTATACATTA GCATTACCTG ATTAATATCT CTTCCCATGG TTATGCCACA
306501 ACAAAATCTT ACCGCACTCA AGAACACCTG GTTATATAAT CGTCAGTGCT
306551 TTTTTATTAT TTCACAATTT TATTTTGGTG TTTTGAGATT TTATATAATT
306601 TTATTTTTAA ATTGTCTCTT CTTTCAGTAA ATATAAAAGA GGATAATCAG
306651 TCTCCTAGAG CTTCCCATTT AAGACATATA TAGCATTCTT ACTTAGAGCT
306701 GTATAGCTTA TCATAATTTC CTTCATTAAG GTCATATTAA AAGAAAAATG
306751 TCTTTTTTGC TGTGAGTCCA CTAATTCACT CAACAACTAT TTTGTAGCTT
306801 CTGTTGTGTA CATAGGAGGG ACAAAGATGA ATAAGTTGCA TTGTTTTTTC
306851 TCTCAACATT CTCACAAGTG TAATCAATGA TAATTATATG TAAGCGATCT
306901 AATACAATTG TACAAATGTT CTCTAGTACT GTGAACAGTG CTATTGGCAG
306951 CAGTAAAAAC AGAACTAACT CTTAAGAGTG GATTTGCTGG AAAATAAAGT
307001 TAATGAAGGA GTCATATTTG AGCAGATCCT AGATAGACAA GCCTGATTTT
307051 GTATCTGCAT CATGAGTGTA CATGAAAAAG ACTTGCAATA TAGTTGGAAA
307101 ATAGGCTACA TGGTGTGTAG CAGACTGTGA TAGGACAAAA ATGTAAGTCA
307151 GCTATCAAAA GGCCTTAAAA TAATTTTAGT CTGTATTTAA TGGATGGCTA
307201 TGTAGGGATT TTTGTTTTGT TTTGTTCTGT TTTTGAGAAA GAGGGCAACT
307251 TAAATACACC TTTATTTCAG AAAGGAATTT TGGGTCATAT TACGTAGAAC
307301 AGATGATCAG TGGGAGCCTA AATGGGAGGG AATATAAATA AACCAAATAT
307351 GAGACTGTTG AATTAAGAAG AAAGGTAAGG AAAACTATGA GATATAATTA
307401 TTACCAGGTG AAAGAAAAAA AATGTAGAAG AGGAGAAGTG GGGAATTACT
307451 GGAGTGAATG GTGATAGTGT AACTAATGTA AGATTTGCAG GGGAAGGAAC
307501 TGAGAGTGGT AGGAAATGTT AATTTACTTT AAAAATATTG TCACCTTCCA
307551 TGTGACTTTG GCAGAACCAG ATCTGTTTAT TCTATATGAA GTTGGAAATT
307601 TGTATCTGTA ACTCAGCATC ATAAATATGG AGGCTTCAGC TCCAATAATT
307651 GAAATGGATG AGAATGCCCA GAGCAAGAGA GGGAGAGAAT GGAGAGAATG
307701 AGAATAGAGA GAAAAAGAGT TGGGAATCCA TTATATTTTA TGTTTTGTGG
307751 ATGTGTGTCC CTTTATGTAA TTGCAATCAT TGCATACACT CATTTAATAT
307801 TATGCCCTAA ATACTTTACT CCATATTGTT ATAGAATGAG AAGGCTTTTA
307851 GGATGTCGGA GTTAAGAATA TTGTGGGGCA AAATAACATA TATGATACGT
307901 TATTGAACCA TATCATCATC ATGTGAAAAG CACTTTTAAA CAAAATCACC
307951 CTTATATTGC CTAACTGCCT AAAAACAAAT CATAGTACTT GCAGTGTAGT
308001 TTCAACAGGT GATAATTATA TGAAAAGCTT TTGATTTTTG TCCCAAAGGC
308051 AAACTGAAGA TAATTTAGCA CTGAGACGTT TCTTTTTAAT TTCCTTTAAT
308101 ACCTAAGAAG ATTTTCTTCT ACAGTGAAAG CATGAATGAT AAAGGGAAAC
308151 AAAAATGAAG AAGCAAATTG TTTGCATGTG TCTTCTTTTA AAACACTGGC
308201 TAATCCTAAA TATTTTGTTT TCAATTAGAG TATCGTGATC TTTGTTTACT
308251 TCCTCCATCT TTATTGAGGT ATAATTCACA AGTAAAATAT GTATATTTTT
308301 AATGGTATAC AATGTGATGT TTTGATATTA GTATACATTT TAAAATGATG
308351 ACCACAGTAA ATGAACATAT CTATAACTTC ACATAGTTAT ATCTGTGTGT
308401 ATATATGAAA GAATACTTAA GATCTACTCT AAGCAATTTT CAGGTATACA
308451 ATACAGTATT ATTAACTATA GTCATCATAC TTTACAGTAG ATCTCCGGAA
308501 CTTATTCATC CTAACAAAAA CTTTATACTC TTTGTCTACA TCTCCCTTTC
308551 TTCCACTACC ACTGGGAACC ACATTATATT CTCTGCTTCT ATGCATTTAA
308601 AAAATATTAC ACATGTAAGT GAGATCATCA TGCAGTTCTT GTTTTTCTGT
308651 GCCTACTTAT TTTACTTAGC ATAATGTCCT CCAGGTTCAT TCATGTTGTG
308701 CAGATAACAA GATTTCTTTC TTTTTTTTAG ACTGAATATT TTTCCATTAT
308751 GTATATATAC CATTTTTATA CATTTGTCTG TCAGTGAACA CTTGGGTTGA
308801 TTCCATATCT TGGATATTGT GAATAGTGCT GTGATGAACA AGGGAGTGCA
308851 AATATCTCTT GGACATACGG ATATTATTTC CTTTGGACAT ATATTTAGAA
308901 GTGGGATTGC TGGATCATAT GGTAGTTTTA TTTTTAATAT TTTGAAGAAT
308951 TTCCTTACCA TTTTTCATAA TTATTTATTA ATTTACATGT CTACCAAAGT
309001 GTTCAACAGT TACCTTTTCT CCACATCCTT GTCAACACTT ATCGTTTGTC
309051 TTTTTGGTAA TAGCCCTTTT AACCATATGA AGTAATATCT CACTATAGTT
309101 TTAATTGTTT TTTCCTGATG ATCAGTGATG TTAAACATGT TTCATATACC
309151 TATTGGCCAT TTGTATGTCT TCTTGGGAAA AATATCTTCT GAGGTTTTGG
309201 CCCATTTTTA ATTGAGTCAT TTGTTTTCTT ACTATTGAGT TGTTTAAGTT
309251 CCTAGATATT TTGGATATCA ACCTCTTATA AGATGTATGG TTTGCAAAAT
309301 TTTTCTCCAT TCTCTAGGTT TTTTCTTTAT TCTGTTGATT GCTTCCTTTG
309351 CAGTGTGTAA GATTATTAGT ATGAGGTAAT CCCATTTGTC TATTTTTGCT

FIGURE 3MMMM

309401 TTTGTCTTTT GTGTTTTTGA GGTCTTAGCT ATAAAATATT TGTGTAGACC
309451 AATGTCCTAA AAAATTTCCC GTTTCCTTCT AGTAGTTTTA CAGTTTCAGT
309501 ATGTTTGCAT CTTTATTTCG CTTTGAGTCG ATATTTGTAT ATTGAGTGAT
309551 ATAAGTGACT AATTTCATTC TTCTGCATGT TAATTTTCAA TTTTCCCAGC
309601 ACCATTTGTT GGAGAGATTG TCTTTTCCTC ATTGTGTGTT CTTGGCACCT
309651 TTGTCAAAGA TTGATTACCT GTTAATGAAT GGATTTATTT CTGAGCTCGC
309701 TGTTGTGTTT CTTTGGTCTA TATGTCTGTT TTAATACTAG TACCATGCTG
309751 TTTTGATTAC TTTATCTTTG AATCAAGATT GTGATCTTAG CTGTATTTGT
309801 TTGCAAGCAA CTGTGCATCT AAATCTCACA AGATTTCTTA CACTAGAAAT
309851 GAATTTGGTC ATAAGAAGAA ACCAAGTATG AATGGTGCAG CATAATTATT
309901 TTATTCTTAA AAAACAAATC AAAATATATT TCTTATATGT GGTAGTTCAT
309951 ATACAAAGAA CTCTGTATCA TTTTTTGCTA TATTCAGTTC CTTTAGTGTT
310001 TGGCACAGTG TAATAGTGCA ATGAATATCT CTTTAAAATC ATCCACTGAA
310051 AAGAGAATTA TATTTTGTAA ACTTCTTTTT GATCTTCAAA TACTATTTGA
310101 AATAACTAGC TTACTAAGAG TTGAAATTCA TTAATCTGAA TAAAATCATT
310151 AAATGATTAT ATTTCATTAA GATTTAATTT TTACTGAAGC CAGAGCAACT
310201 TTATATACAA AAGATTATTT CAAAGTCTCC TGGTGCTTTG GACCTTATTT
310251 CAGAGAATCT GTCAACTTCT GATTCAGAAT GCTATATAAT CTGTGTGCAT
310301 GTTACCAGGA CACGTGATTG AATATTATTT GTCTTTTTTT TTCATGCTTT
310351 TGCTCTCTGG TTCAGTTTTG GAGACTTTCA CTCATAAATA TTCTATAATC
310401 AGAATTTATT TTATTTGGAA AACACCTTAA AAACTACCTA TCTCATCAGC
310451 TGTCTAATGT GTACAGTATG TTTGACAAAT GTTCCTTCAA TCTGTACTTA
310501 AACTTTTGGA GACTGATAAT TCCCTCTTTT TTTGAAATAT CTCAATATAA
310551 AGATCTTACC TAACATACAT CTTCTCTTGC CTAGTCTTAA CACATTAGTT
310601 CCTTTTCTGT TTTTTGCTAA GTGGTTTCCA GTTTCCTCAC CATATTCATT
310651 TCAGTTTGAG GACCTACTAG GATCCATTTG TATAGGGTAG AACTTGTATA
310701 TTTAAGAATC ACACAAATAT GGCTAAAGTC CTATTTCCAG TCTATAGTAC
310751 CCATGATCTT GGGAAAATTA CTTAACTTCC CTAATATTCA ATTTTTGCAT
310801 CTGTAAATGG TACTAGCAAC AAATATAGAG GCTATTGTGA AGATTAAGTT
310851 AGAAAGTGGC TAAAATATTC TGTAAAATAC TCTCGTAGTT TAACATATTT
310901 TCATTTCCTC CTCTGACTTC CTATGTTTAC AAGCAGATCG ATACCATCTC
310951 TTCAAATGTT CTAGATTCTA CTAAGTAATA TGAAGATTGC ATCAGCTTTC
311001 TGGCAGTTTT TTGGCCTATT TACTCACAAG CCTCTATCAA GAAAAATTTA
311051 AGTCATTTTT GTACAAGAAA TGCTAGCCTT CATATCAATA CCATATATAT
311101 CTTTGGGCCC AGCTGGTTAA GCCATGTCTT AGAAATTTAT TTTAGTCAGC
311151 CATTGGTGTT AGCCAGGCTC CCAAATTTGT CTTTTGCCAA CTTGATTATC
311201 ACTTCCAATT AATCAGTGAC AAAACACTGA AACAAAGCAG GACAGGAGCA
311251 GACCCAAGCC AGGCTACTAA GAAACTATGC ACTAACTCAT TACTCTGCAC
311301 ACTTCATTCA TACAACTGCT TCCAATTCAT CTTACTTTAC CAGGATCTAA
311351 TGGATATTTC TCTAGGTGCG TGTTGCCTAC AAAATTATTA TGAGGAACAC
311401 TGTCAAATGT CTTGATGAAA TAGACAAAAT GATTCTACCT GTTTATGCCT
311451 CTGGGCGCAG GTTGGTCAGG TCCATCAACT AGTGAGATAG GAGGCAGTGT
311501 CTCCATGAAG ACCAGAAGCA ATAAAAAGCT GAGCACAGAC CAGTCTCAAT
311551 GCAGTCTCAA AAATCAAAGC CGCAGAAACT TCAGGTACCA CTTACAGGAA
311601 GAGGGCTAAA ATAAAAGGGC AAATCAGTAG CTTAAAAAGA AATGGAATTG
311651 GAGAAGATGA GACAGAAAAG CAGGAGGATT CTGAGTGATT ACTATGAATG
311701 AAGAAATGGA AGTATTAATA GCTTTGTTTT GCCCGTGTAA ATGGAGTTGT
311751 CTGAACTTAC GGAAAAGGCA GGCAAAGAAT GAACATATAA TTGTTACTCA
311801 TGTTTTTGTA TTATTTTAGT TGTTTACTTT AATCTGTCAA ATGGTTTATG
311851 GTAAACTCTG TTGGATGCTT GTTTTTGTAC TCTTCCTCTG CAGAAGCTCT
311901 GAAATATTCA TATGTACTAT GTAATTTCAT TCAGGATCAG TATAAACCCA
311951 GTTTTAAAAA TTCACCTTTG CCCTCCTTTT GAATGCTGAG ACTCATTTGC
312001 TGAATTCCGG AGTTGCAGCC TTGTCTCATA ATTTCCCAAA AGTCACTGAT
312051 AAAATCACAT GAAATTTTCC CTTGTAACAC TGGAATATAG TTTGTGTGAG
312101 AAAACTTGAA CTAAAGTAGT TAGTTATCTT CTTATGATTC CTTACTGATT
312151 TGAAGCTCAG GTTCCTTCTA GGTCAATGTA TCTCTTTGGC TCAAAAATTA
312201 TTCTTTCTAC TGATTAATCA AATATGAATT TAGATGCTTC ACTTCTTTTT
312251 AATTTCATAA AAATTAGTAC CTTGGTGATG TGTACATACC CTATTTCAAA
312301 TTTATCATCT GTATATTTTT AAGATAAATC ATAACAAAAT TCTTTCTCTT
312351 CTAGAAACAG TAATTCTTCT TAGAAACTTA GTACAGGTAA GTTTTATAAA
312401 ACTTGATGGG CAGTTTTTTT TTAATTTAAA AGTTTATAAA ACTTTGTGTG
312451 GCTATTGATT GTACTTAGAG TAACCCACAT TTGCATGATT AGGGAAGTAC
312501 AAAAGCTTAA AAGTTAACCA CTTCCCTGCT AATGTAGAAA GACAAGTTGA
312551 TAATGGACTG AGTCACCACT TCTTCTAGGC AACTGCTAAC ATGAGGAGTA
312601 GGTTTAAAAA ATTAAATTTC TTAGTTAAAA AAAGGGTTTT AAAAGAGTAT
312651 TGCTTACTGT CATGTATATG TTTTTAAAAA TTCCTATTTC TTTTATGTTT
312701 GTCTCATAGC TTATCCTTAA GCTGAGCAAA ATTATTCAAA TGTGTTAAAA
312751 AGAATGTTAT TTTCTAGATC ATAATACCAT GACTCTATGG TCTGGTGGGA

FIGURE 3NNNN

312801 TATGTGAATA CAACGATGAG TGTGTTTCTT TCCCTTGAAC CAACCAAATA
312851 AGGTTTTTTG GCATTCATGC TATATTAAAA GGTATAAACA TAAATAATGT
312901 TATAGTGTAA ATAAAATAAT GTTATAGTGT AAGTAAAAAT AAACACTGGC
312951 TTCTAAAAAA CATTTAATAT ATGAAAAAAA TTTAATATTA GATGACAAAT
313001 ACTTCTTTTT AATGTTTATT GGTGAAACAG ATTCAGAAAT GTTACGTTCC
313051 TGCCAAGATC ACACAGCTAT TCAGAGAAAA CAGAATTAAA TAAAATCCAT
313101 ATCCTTTTCA ATATAATTAA ATGCTTCAAA TGGAAGATAT ACCAATTTCT
313151 CTCTTCCCAC TGTTTCCTAA AGCATGAAAC CTGTCAATAC CACCCAAACT
313201 CATATTATTT TAAGAAAGTA GTTTCCAATT ATTTTGAGAT CGGAATCCTT
313251 TAGAGAATCT GGTTACAAAA ACTGTGTACC CTTTCTTCAG AAAAATTTAC
313301 GAATGCCCAT TCCCAAGCCA CATTTAAGTA GTAACCAGCT GGGCGGTTGT
313351 CTAAAGTGCT AATGTAAGAG TAGCACTAAA ATGACGCTAG AAATATGTTG
313401 AGATAGAAGA GGTTGTCTTA CAGGAATTCT TAGAGATAAT CTTATATGTA
313451 GGTGGAAGTT TTATTTTCAA AAGCCTCTTG GGATGGAAGA GGTGAACTCA
313501 AAAATTAGGG CTTCCTCTCA CTCACATGTC ACTTTGGTGT ACACTCCTAC
313551 TTTCTGGTGG ATCCAGTTGA ACATATTGGA CTGCTTCAGA TTCCAAATAC
313601 AAACTGTTTT TACAAAACCA CTTGTCCACT TGGCTGGGTG CCATTGTTAC
313651 CACGTGATGG AGACCTTGCT CAAAGGCAGA CACTCATGGA GCACTGTAGG
313701 GCTATATAAC TGCTTTCCCA AGAGGTTCCA TCCAGTTAAC TGCAAGATTT
313751 AATTTTTACT GAAAGGAGTA TGCTAGTGTA GGACTGTAAT CCAGAATAAA
313801 TGATAAAGGA TGACTATTGC TCCCAGTGTC CCATTTCTTT ACTTTTCCTA
313851 AAGCAAAAGT GATCTGCTCC AGTTCTAAAA ACAATGCTGG ACAGATATAT
313901 TGAGAATATA TTGAGGAACA CCAAGTCACC AGCCTACACT GCTTTTCAAA
313951 CTGAATGGGA TGCTTTAGGT GTCTTGGTCT GGTCCCCCAT ATTCATCACA
314001 TTTATTTTTC TACACATTTT CAGGGGAATT TATAACCACT TGATGCTTAT
314051 AGATGTTATT GTATATGTCT TCATTAATTA TTCAATGAGA ACATACTATG
314101 CCAGAAATTA AACTTGTTTA CATACGTGCC CTCAATAACA AATACAGTAG
314151 AATGATTACC ATATTTGATA ATATTAGATT TTGTTTAAAA TCTAGAATTA
314201 CTATAAAATT CACACAAAGC CATGTTACAT ATTTTGAAAA CAACACAAAG
314251 AATTGGAAAC TTCAGTTTGG TCCACTCTCA TTTGAGCTAA TCTCAGTTGC
314301 TTCTATGGTA TCAACAATCG TTGTGCTTGA GGAAGACATC AGCTTGAATT
314351 TTGCATGTCT CTGTACATTA ACAATATCAT CTCAATGACA CAGTCACAAA
314401 ATTCCTACGG TTTTCTATTG AATTACGTGT ATTTTTAAGA TATGAGATTG
314451 TTTTAATGGA TCTCAGAATC ACCTGTTATA CATCATGTTG GTTTGGTAAG
314501 CATGGAAATC TATTGATTTT ATATGTTCCA TTTTTCTACT GAGTAGATAA
314551 TCCTTATATA AATCAAAATG TATTTTAATA GAAAGAAAAA AACACTACAA
314601 ATATCTCTGG GCCAATAAAG TTCTCTTGGT ATCAGGGAAC TTGAGTGATT
314651 CATTCCAAGC TTGTACGTAT TTCATTGCTG AATACTTACC AATGATAAAA
314701 AGCTGAAAGA TTACAAAAGA TTGTATCATC CAGATAGAGA ATGTGTTTTT
314751 GTCACCAAGA GCCTTATAAG TTACTTCTGA AGAGTGTTAA TTGTATAGAA
314801 TTCTTTATAT ACAAGCCAGT GAACATAGAA AATCCATAAC CTAATTATAT
314851 GATTAAAATA TCAAATATAA ACATGTATGT GTATAAAATA TATGTATGAT
314901 ATGTTGATAA GGCAAATCCT GCTGTTTTAT GAAAAATAAA AGAGGTCATG
314951 AGGTTATTTA ATGTTGGAGT GTTTGAAAAA ATATTTATAA TAACACTGTT
315001 TTGTTTAGAT CTCTTTGTAT ACAAAGCTTG TCCTTATGCA TATGCTGATT
315051 TCTTCTCAGA ATATTATTTT ATCTGATTTA TATATAGTTA TAACCTTTGC
315101 TGTTTTTAGG TTTATCAAAG AGAATACTAA TATATGTGAT TTTCATTTCA
315151 TCACTTATCC AAAGGTAAAT GAAAATCACA AATTAGGTAC AATCTACAAT
315201 ATTTTTGTCA GTTTAAAAAT GTAAAATAAT AGCACATGTA GTGGTACTAT
315251 TATTCGTGTT AAACTTGAGT TGCACTGAAG CATTATTTTC TTTAAAAATT
315301 CAGTAATGTA TTTAAAAATA TACACGTGCT GCCACAATAT ATTTCCATGG
315351 TTAATTATTC ATGTATACGA TAGCCTAGTT TCTCGCCTTT TTTGTTCATT
315401 GTATATTCAT ACTACAAGTA AGGATTTTTC TGCCTTAAGC AGCAGTCCAG
315451 TTTGGGCTGT GTAATACTAG GATTATTGGC ATCGACATCT GTCTTTCCCT
315501 TAAATTTAGG GAATTTAAGC CAATAAGCTA CTCCCGTAGA AATTTGAAAT
315551 TAGGAGCATA GAAACTTTGG CAATACATGT GTGGGTCCTG GAAATGTTAA
315601 ATCATGTAGA GGTGGAGCTG GAACAGCCAT TTTCATGAAA GCATGTAAAT
315651 GTTAAGTTAA TAGAGAAAAT AGTCATCAAA GAGAATCAAA AGGATAGTTT
315701 GAATTCATAG AGAGAAAGGG TCAATAGACC GTTGTGGATT AGAGAAACAA
315751 TCGTACTGAA ATCAGTTTGT TTCACTTCAC AGAAACCAAT TGCTAAATTT
315801 TCAGGAAGTT TTGCATCTGG GGTGGCTTCA AGTGGACAAG TGATTTGAAA
315851 TCAGCCATAG TGATGTACTT CTGCCATAGA ACTTATGCTC CAAATCAGGG
315901 CTTCCTGTTC CTGAGAGTTG TTAAACGTTT AGCTGCATAC ATTGTCACAG
315951 AGAGGGAGAG ACAGAGAGAG AGAGAGAGAG AGATCTCCTG AGTAGTTTAT
316001 CTGATCCTTG ATAGCTTCCC AGTTCCCAGC TCTAAATCCA TGAGAACCAG
316051 CAATGCTTTA TTTCTATGGA ATGCATTTGT ATCCTGTTAA TAAACCAACA
316101 TTTATGTTCT GCTCATTTAG TTCCCATAAA AAATTAATTG CTACATTTCT
316151 AATCAATATA ATTGGAAGCA AGGAAACAGG ATGGTAACTT ATATTCATGT

FIGURE 3OOOO

316201 GAAATGCCTT ATATGTATAT GCTGAAGTCT GTTTCTTTTT TGACCCCATA
316251 TAGTTTAGAA TCAATCCCAA ATAACATTTA ATGCCAACTA TGTTGACTCC
316301 ATAGCAAGAC ATCTTTTTCC AGATGCGTTT CAGTATTAAT CTGATCATCA
316351 CCGAGAGGAA ACTTAGGGAG GAATAAAGAC AATAAATTCA GTATCTTAAA
316401 AGATATTTGA GTATTTTATT AAGGATTTTG CATTTTTAAA TATAGAGTTG
316451 TGATCAATTT TGGCCATCAC AGGCATACAG AAAAGTTTGC CCTGAATGAT
316501 TAGAGAGGCA TTCTGTTTAA AAAAAGAAAG AAAGAAAGAA AGAAAGAAAG
316551 AAAGAAAGAG AAAGAAAGAT GTTAACCTGG ATTATCTTTC TCAATTTTTT
316601 CCTAGTCTTG CTTTCACCAC TTCCTCTAAT ATCTTTTAGA TTAGAGCGAG
316651 GTTAGTAAAT ACCTTGTCAC AAATTACCTT AAACAGACTC ACTGGTGGAT
316701 GTTATTTTGA GGAGAGGCCA CCACTCTTCC TTGTGTCTAT CCCATCCCAA
316751 CCTCAGCAGA GCTTCTAGAT ATAGAAAAAT GCAAAATTCA GTCATTCTGA
316801 GACAGTCCCA CTCATCTTGG CAAGACAAAT GCAGAAATGT GTGCTCTACC
316851 CTAAGAGTTA CTAAGGCCTA GTAACACCCA CAGGGGATGC TTCTGCCTGT
316901 CATTGTTGAC CTCAGAAATT TTAAGGTTAG GTATCAAATG CCAGCAAGGG
316951 GCATGAGCAG TTCCAGATCT ATCTTTTGAC TTGCTGGAAG CATAATTACT
317001 AAAATACAGT GACTGGCCCA CTTTTTTAAG GCCTCACAAA TTTTAATTGG
317051 GAGCACCTTG ACCCCCAAGT ACAAAAGGAA GGATTTCACC TCATAGGAAA
317101 AAGTCAAGCA ATATTACTTA GAGAAATGCA GGATATCATA AAGGACTCTT
317151 ACAAACATAT GTGCCTTTGG GCTATCAGAT TTAAAGACAG AAGAAACTAA
317201 TGCCCTGCTT GTTTTGTGTT ATTTAGGAAA TGCCACCAGA AGGGACCATT
317251 ATTTTCCTCT TTGAACTAAA TGTCTTAAGC TGTTTCAGGA CAAGCATTAA
317301 CCTTTAGCTA AGAAAGAATT TATTTAGGAT ATATATTGAA ACACACTTCT
317351 ATTGATTGTT TCTGGCATAT TGCATTAAGT ACAGAATATT TCTATAGAAG
317401 CAGCTCACTC AGTTCAACAA GGTTATTTTT TTCCAGTTAT GCTAATAGGA
317451 AATTTAAATA TTCTACTACC ATATGAATAG ATAGGAATAT TTCTATAAAA
317501 TTTAAGATCA CATCTGTTAT CACTATACAT ATTTTGGATT TCTTTTTCCC
317551 TTGAATGCAA GAATAAGTGC AGATATTTAT TGAGAGGAAA CATGGAGCTG
317601 TTTGATTTGT CTCTGGCTTG TTAACAATTA AAGCAGATTA TTTTTTGGTA
317651 TCTTAATTTT TCTAAATATA GAATATAGTT ACCAGGTTAT TCTCTCCTTC
317701 TTCCAAGAGA AATTGAAAAA TGACTAAAAA TTCTTTATTA TTATGTGGAT
317751 AAATAAATGA TTTAAATAAA ATAAATATTT TCAGACAATA GTACTCAAAC
317801 GTGTTTAATT ATCAGTTAAA TTACAGGTTG CTGACTAAAT AGCCCAGGAG
317851 ATAGTCTTAA ACACACACAA CACTCCTCTT TCACTGAATT TCAAACCTAG
317901 TTTTAAATGC TTTCAGATTG TTTTAGAGTA TTCTTTTTAT TGTAATAAGG
317951 ACATAAGTAA AGACCATTGA TGTAGTTTGT CTTTGTAGAA GACTGAGAAA
318001 TGACTTCGAT CAGAGGCACA CATCCCACTG TGCTTTGGTT TAGTGAATAG
318051 ATTACAAAAT GAGACTTATT CAAGATCAAA TGGCAAGGAG GCGAGTATTC
318101 AAGTCTGTGA TTACAAGACA AAAGCCTATC TTGATGCAGG TATGCGATTT
318151 CCTACTACTT TAGAAGGCAT TTTTTTAGCC TTCACAGTAT TGCTGGGCTC
318201 TTAAACATTT GGAAAGTTAC TGCAGTTTCT TTCCTTGACC TAGGCTTGGG
318251 ACTTACTGAT TTAGACATAC TGGCCATATT AACAAGTTGT TACCCCCACC
318301 TGATTCTAAT GGCCAGGGGA TTGTAGTTCT CTTGTCTCAG AATCCACAAC
318351 ATGCACTGGC AGCTTGGAGC ACAGCCCAGG AAAGCTAACT CCAGGTGTAA
318401 GGCTTCAGCC TGCATTCTCC CAGTGCAGAA GAAAACAGTA ATTTTCCCAC
318451 TTTTCTGAAC AGCAGTTTCA ATCCAAAAGC ACGATGAAAA AGTAAAATTT
318501 ATCCAAGTAC TGCTTTATTC TTGGCATTTA GCACAAATGA CAATATAACT
318551 CCACAAAACT ACTTCCAAAT AATTACATGA AGAAGCATAG TAAGAAACAA
318601 TTTATTAACA TGTCACTACT AGTTTTCTCC TAGGAATTTA GATATGCCAC
318651 ACCAAAAGAT GACAAATTAA TTCCCATTAC ACTAAACTTC TACTAGGTTC
318701 TTATGAATGT TACATTTGTT CTCCTTTGTA CTCTGCACTA AGGAATGATG
318751 GAAACTTAGA GCCTTCACCT GTGTTAAAAA AAAAAAAGAT TTGAAGTAAT
318801 AATACAGGAG AACCAAATTA AATCCATTTG AACTAAAACT AGCATATTAA
318851 TTCAGTTCTG CAGATGTTTA AATGTCAATA TTAGTTTATT AAAAACCACT
318901 ACAGTAAGAG CATAAAGAAG ATGGACCAAT GGAAGGAGGC AAAGGGAGAA
318951 GGTGAAAAAA AAAAAAAAGA ACACTTAGAT CTAATTGAGA AACGAAAGAA
319001 AAAATTAAAA CTGAAGAACA CAATAACAAG GAAAAAGACT GCAGGGTAGG
319051 GAGAAATAAC TTTTTCTCAC CCATCCTAGA TTCATGGCTG AGGTCCCTAG
319101 AACAAAAAAC AGATTAACAA GAGAAAAACA TACAAATTCA TTTAATAAGT
319151 TTTACATGAC ACAAAAGCCT TCTTAAGGAA ATGAAGACCC AAGTAATAGT
319201 TAAACTTGTG TATTTTTAAG GTAGGTTTGC TAAGAGTGGA CAGCAGTCAG
319251 GGAGAAATGT AATTGTACAA AGGGATATGA TCTAATGGTA ATAAACTGGG
319301 AGGGAACTTT GCAAGACCTG CTTTGCTCTG GATTTCTGGG GNNNNNNNNN
319351 NNNNNNNNNN NNNNNNNNNN NNNNNNNNNN NNNNNNNNNN NNNNNNNNNN
319401 NNNNNNNNNN NNNNNNNNNN NNNNNNNNNN NNNNNNNNNN NNNNNNNNNN
319451 NNNNNNNNNN NNNNNNNNNN NNNNNNNNNN NNNNNNNNNN NNNNNNNNNN
319501 NNNNNNNNNN NNNNNNNNNN NNNNNNNNNN NNNNNNNNNN NNNNNNNNNN
319551 NNNNNNNNNN NNNNNNNNNN NNNNNNNNNN NNNNNNNNNN NNNNNNNNNN

FIGURE 3PPPP

319601 NNNNNNNNNN NNNNNNNNNN NNNNNNNNNN NNNNNNNNNN NNNNNNNNNN
319651 NNNNNNNNNN NNNNNNNNNN NNNNNNNNNN NNNNNNNNNN NNNNNNNNNN
319701 NNNNNNNNNN NNNNNNNNNN NNNNNNNNNN NNNNNNNNNN NNNNNNNNNN
319751 NNNNNNNNNN NNNNNNNNNN NNNNNNNNNN NNNNNNNNNN NNNNNNNNNN
319801 NNNNNNNNNN NNNNNNNNNN NNNNNNNNNN NNNNNNNNNN NNNNNNNNNN
319851 NNNNNNNNNN NNNNNNNNNN NNNNNNNNNN NNNNNNNNNN NNNNNNNNNN
319901 NNNNNNNNNN NNNNNNNNNN NNNNNNNNNN NNNNNNNNNN NNNNNNNNNN
319951 NNNNNNNNNN NNNNNNNNNN NNNNNNNNNN NNNNNNNNNN NNNNNNNNNN
320001 NNNNNNNNNN NNNNNNNNNN NNNNNNNNNN NNNNNNNNNN NNNNNNNNNN
320051 NNNNNNNNNN NNNNNNNNNN NNNNNNNNNN NNNNNNNNNN NNNNNNNNNN
320101 NNNNNNNNNN NNNNNNNNNN NNNNNNNNNN NNNNNNNNNN NNNNNNNNNN
320151 NNNNNNNNNN NNNNNNNNNN NNNNNNNNNN NNNNTACATA GATGTACAGA
320201 CATGAAGTCT GAGATTTTAG TGCACCCATC ACCTGAGTAG TGTGCCCTGT
320251 ACCCAGTAGT CATCTTTCAT CCCCCTCTTA ACCTCCCCAC TTCTGAGTCT
320301 CCGGTGTCCA TTATACCACT CTATATGTCT TTGCATACCC ATAGCTCAGC
320351 TCCTACTTAC AAGTGAGAGC ATGCAGTATT TGGTTTTTGA TTCCTGAGTT
320401 ACTTCACTTA AAATAATGCT CTCCAGTACC ACCCAAGTTG CTGCAAAAGG
320451 CATGATTTTA TTCTTTTTTG TGGCTGAGTA GAATTCTATG GTATATATGT
320501 ATCATATTTT CTTTATTCAT CAGTTGATGG GCAATTAGAC TGAATCCATA
320551 TGTTTGCACT TGTAAATTAT GTTGTTATAA ACATGCATGC CAGTGTCTTT
320601 TTGACATTGT GACTTCTTTT CCTTTGGGTA GGTACCAGTA ATGGGATTGC
320651 TGGGTCAAAT GTTGGATCTA CTTTTAGCTT TTCATCTGCT CTTAGGCCTA
320701 GCTGTTGGAT TATAATACTT GATATCTAGC TTTGGGGCAT AGAAGCATTC
320751 TAAACTCTAG ACACTGAAAA ATGTACATTT TGGGGGATTT TTTTTGGAGA
320801 CAGTGTCTCA CTCTGTTGCC CTGATGACTA TGCAGGAGTG CAGTAGCATG
320851 ATCTCGGCTC ACTGCAACCT CTACCTCCTG GGTTCGATTC TCATGTGTCA
320901 ACCTCTTAAG TAGCTGGAAC CGCAGGCACA GAGCCACCAC GCCTGGCTAA
320951 TTTTGGTATT TTTAGTAGAG ACAGGGTTTT GCTATGTATG TTAGCCAGGC
321001 TAGTCTCAAA CTCCTGGCCT CAAGTGATCT GCCCACCTTG GCCTCCCAAA
321051 GTGGTAGGAT TACAGGCCAC TGCCGGTGCC TGACCCCATT TTTAGGTATT
321101 TTTACACTTT TCTTTCTTCT ACTACCTGAA TTTTTATGTC TTTTTTTTTT
321151 TTTTTTTTTG AGACAAGGTC TCCCTTTGTC ACCCAGGCTG AAGTGCAGTG
321201 GTGCAACCTC AGCTCTCTGC ATCCCCTGCC TCCTAAACTC TAGTGATCCT
321251 CCCACCTCAG CCTCCCAAAT AGCTGGGACT ACAGGTGTGC ACCACCACAC
321301 CCAGCTTATT TATATATTTT TTTGTAGAGA TGGGATTTCA TCATGTCGTC
321351 CAGGCTGGTT TAGAACTGCC CATCTTGGCC TCTGAAAGTG CTGGGATTAT
321401 AGGAGTGAGC CACCGTACTC ATTAGAATCA CCTGTCTATA GTAACACAGA
321451 CATCACTTCC TTTGTGTAAA AAGGTACAGT GGTGGGGCCA GGTGCAGTGG
321501 CTCATGCCTG TAATCCCAGC ACTTTGGGAG GCGGAGGTGG GCAGATCACG
321551 AGATCAGGAG ATCGAGACCA TCCTGGCTAA CACGGTGAAA CCCTGTCTCT
321601 ACCAAGAACA CACAAAAAAA TTAGCCAGGC GTGGTGGAGG GTGCCTGTAG
321651 TCCCAGCTAC TCAGGAGGCT GAGGCAGGAG AATGGTGTGA ACCCAGGAGG
321701 CAGAGCTTGC AGTGAGCCGA AGATCGTGCC ACTGCTCTCC AGCCTGGGCG
321751 ACAGACTTTG TCTCAAAAAA CAAAAACAAA AACGAACAAA AAAAAAAACA
321801 ACAAAAAAAA GTACAGTGGT AAATTCGGTG TTAATTATAT GCATTACTGT
321851 TAAAAACAAT TTTTTCTGAC ACTTCTTAAA ACAGTAAGGC ACTTTATTCA
321901 GGATTATAGT AATAGGTGAA GGAATACTGC AGTGGAGTTT TGCAGTAGTA
321951 GAGAGAGACT GGGCTCAAGT CTGTAAATAA GAAATAAGGG AATTCATAGG
322001 CAAGGAGCAG CAGGGTTGGG GAGTTGGTAC ATGTAAAATT GCTGATCAAG
322051 TAGAGTAATT CTTGCTGAAC TGACCTATCA GGATTTCCAC AGAAGGCAGG
322101 TCAGGGTGAT CAGACATTAC CTGAGAGATA GTGAGAGATG AGGGATTTGG
322151 TCAGATATTG AAGACTATCA GATATTGAGG GTGGGGCATT CTGGCTAAAC
322201 TGATACAGCA TTCTTGCTAC ATTTGGGTTC TTGAGAAAAT GCCCTAGTGG
322251 AGCTCAAGGA GATTAACTAG AGTTAGGTCA AGGAATAGTC TTTGTCAGTA
322301 CAAACTAAAA TGGAACTTCA AGGTCTCTCA TATGATCAAA ATAAATATTA
322351 TTAAGTATCT GTCAAAGTGC ATTTTGTTGA TAAAATTATT TCTGCTTTTT
322401 ACTACGGGTG GTGGTAGTGA CAGTACATGG AACTATTACT CATTTCTGAT
322451 AACAACTTTT GATATTTTCT CTCTTGGATT ATGCACATGT CTACAGTATT
322501 CTGGGTACCC TTCCTACATT CTCTTACCAT CTCGGGGTTG TTTTTTTCTC
322551 TTTTTCTTCA TTTTTTCTCT AGTTACCATC TGTCAAACTG GATATCTGTC
322601 AAACTGGATT TCTCAATTCT TCTACATATG GTAGTTAAAT CCAATTTGCT
322651 TTTATTGTAA ATTGGTTTGG TCATAATTCA GGTTTAATCC AGTTTTTATA
322701 GGATCATGTT AATGATTTTG TTTTTTAATA TCTATGTTCT ATTTAATTAT
322751 ACAAATATTT CTAGTTGACA CATTTTATGA CTGTCCTGAA TGCTATTTTT
322801 GTCATTTTTC TGCACCTGTT AAAATATATC CATTTCCTTA AACAGACTTT
322851 ACAACCTGAA TTACAAAATT TCCACTTATA CACATCCTAA TTTGTTTCCT
322901 AACCTATTGA TACATCTTTC CAGTTAGACA AGTTATTTAG CTATTCTCCT
322951 GCCAATATGC ATATTAATTC ATCTGACATT AGGGGAATAT TAAGGAATGT

FIGURE 3QQQQ

323001 AGACTTGAAT AATTTGATTA CATAAAACTT CTAACAAGAC TATGCCTATT
323051 CTAGGCTATG GGTCTTTCCT AGATCTGTTA AAAGTGAAAA GCATTTCACT
323101 TATTCTACCG TGATTCACCC TTATTATAAA CAAACCATAT CCTAGTGAGA
323151 AGAGCTAAAT TTGTATTTTG GATGATATGT TCCGTGAAGA AATTATTATA
323201 ATTATTGTAT TGTAACCACT TCTGTGCCAT TTAATTGACA CAAAGTGATC
323251 TTTAATCATT CAGCAGTTAA TTCTTTCATT ATTCCATCAG GAAAAATCAA
323301 TAGCACAGTT GATTTATATC TGTAGAAACT CTGATACTAC AGTGGCAGAT
323351 TAAAATTGTC ATAGCAGAGA AGAAAAAGAA CTCGTATTTA GAAAAGGAAA
323401 ATTATCTAAA TTAATTCCAC AAGTGCATGC TTTGCTTAAT TTTTAGATAT
323451 ATAATGTAAA ATATACAGAA GTCTACATTA TATGAATGTA TACAGTGGTA
323501 TGTATGGAGA TTTTCAAAAT ATAAATGGTA GTAATATATG CATGGGTTCA
323551 TATAGAAATA AATGGATAGA TGATAGAAGA TAGAGAGATA GATACTTAAT
323601 ACACCCTTGT CAATATCCCC CAAAGTACTG TATAAAAAAT AGGAACAGAT
323651 CAAGGTGTAC TTACAATATT CCTTAGTCAT AATAATGGTT AAATTGAACT
323701 ATAGCAGTAA CAAATGTAAA ACAATTGTAA TAGGAGTTAT TTGGTGCCAG
323751 ATTTGTTAGT AAAATAATAA ACAAGTAAGT ATGAGGTATT GGAAAAATCT
323801 GTGAATTTTT ATTGTATTTA TTTCTTGCAT AATATTTATC ACAGAGTTAC
323851 TTCATTCTTC CAAGAAAGGA TAATTATGTA CACATGACCT TATTTACAAG
323901 TGGATGGCTA AAAATGACCC AGATGCCTTG TGTATTATCT AGGCAATCTG
323951 CCAGGAAGTT GGCCACAGCA GAGAGGATCA GAAAGTTCCC ACTCAGTCCA
324001 GACATGTAGA GTAATAAACA TTTTCATCTT GCTGTACTGT TATTGCTACA
324051 AATAATAAGC TAGAAAATTT AGATCTTGAT CAAAGTGTTT GGATGTCTAT
324101 ACGTTATTAT ACAGGTTGTA TGTTAGCAAG TCAGCCATAG CAGGCAAACA
324151 ACCTTATACG GTTTCAATCA TAACCTAAAT GACCTGCCAT GTTAAAAGCA
324201 AAACCAAACT AAATATAGTG TGTCTTCCAC TAAGGATGAA GAAAACAGAT
324251 TAGGTAAATT TAAAGTGTAT AAACTTGTAA ATTGTATATA TGGCACTAGA
324301 ATGATGTAAT ATTACCCATG TGTGAAAAAC CTGTGAATAT CATTATACTA
324351 TTCAAAGAAG CCAGCCCTCA AGTTAGTTTG ATAATAAAAA CAACAAATAT
324401 GTACATATGT ATTGTAAAAT TACAGCATTC AGACCCTTTG CTTTACAGAG
324451 CACTTATCTA GTTTAAAATC AATGCATATA TTTATTAATT CATAAAGCAG
324501 GTATTTAATG AGCACTTGCA ACGTGTCAGG GACTGTTTCA AGGTCTTGTA
324551 GACACATACC GTACTTTCCA AGAGAGGCGC TCAGGGTTGA TTAAAGTGTT
324601 GAATATCAAA TGTTATTTTT AAAGTTCTTT TCATATTTGA ATTATTTGAT
324651 ATGGGTGGAA TCCTAACTTA CGGGAGGTGA AAAACTGTAA AATCATTCAT
324701 TCAACTTAGT CTTTTTAAAT ATCTCACTCT ACTCCTCTAT TAAGAAGTCC
324751 TGTGTTAGTA AAGTAGATGG CTCCTTACGT GATGATATTT AAGGAGTTAT
324801 TGACATGTTT TCTTGCTCTT AGCTGTTTTC CAGATGCTTG TGTTCCTGCC
324851 TGAAAGGATA TTATGAAAAA ATGTCCTCTA ACATCACAGC ACACCTTTCA
324901 GGGCTTAACA CATTAAGCTA TTACCAGTTT TATTTTACAA TCCTAAAATA
324951 TTAATTTATC TAATTACTTT ACTCAATTGA GAATACAAAG CTGAACAAAG
325001 GGACAATTAT AGAATATTCC ACATCCCCTA AAAAGTGTGG CTCTGAGTAG
325051 AAGAATATTG TCCTGTAGTA AAGTAGAATG TAGGCAACCA AAGTAAATTT
325101 ACAAAAACTA ATCGAAGTAT GCATTCACCC AGGGCTAAGC TTGCTACTAA
325151 ATTCGTTGTA TATAAATTAA TAAAATAGAG AAAACAGTAT TTGCCTTTGA
325201 GGATATTGAA CTCTAGCCAC TCAAGGTAAC GTTTTACTCT CCTGTTACAG
325251 CATAACAGTG CTAAAAAATG TCGTATGCAT ATATACAATT TTAAAAAAGA
325301 ATTTTAAATG AGTCCATAAA TGACAGAATG GAAAGTAAAG GATAACTGGT
325351 GTTCTTAAGA GCTTCCAGAA GTTGGTAAAG GTTGAGAATT TTCCGATGAG
325401 ATAGTAGACG TAGATCATAG GCACATGACA TCCTATGAGA GTGAGCAGCC
325451 AGAGTCATAT GACTGAAATA GGCAGACAAA GTAGGAAAGT GATGTATGTT
325501 TGGCCTGAAA TACTGGGTTA AGCCATCTAT ATTTGGTGCA GTCAATGTTT
325551 GACAAAAATA GTTGCTCAAA GCTTAAGCAA CAAGGTTTTT TAAGATATGT
325601 AAATCAATTA AAAACCATTG AAATTGAAAG AGTAAGTTGA TGTAAAAGAC
325651 TTATAGCCAG ATTTTTCAAA TGTATTTTGT TCACATATGC TTTGTCTTCT
325701 GTTTTCCTAC AAAAAAAATC AGAATTTTCA ATAAATATTT ATTAGAAAAA
325751 TGTACAGTTG ACACAAACAT TTAGAATGAC TCTAGAGGCT ATAAAAGCTT
325801 ACTTTCAAGT GCTAAGAGGC AGAGTTAAAA TTATCATAAA ATATCCCTAT
325851 GTCTAATGCT AACATGCAAA CATAAAGTTA CAATGTATTT TGTAAACTAT
325901 ATCTGAATAT ATAGACCAGG AAATCAGAAA TATCCTTCTT GATGTTTTCT
325951 ATTCTGGAAT GGCATAAAGG TGCTCCCTTT TGTAACTTGT ATTAAAATAT
326001 TTGTGTTAAT AATTGATATG TTAACAGTAC AAAATGATGA GAATATCATA
326051 TGAATCCCTA TACCACCTAG GAGATCAAAG AAGTCAAAAG TGTCTTCTTC
326101 AGTAATTAGT TTAATTTGTT CTCAATAGGG AATTCTAAAT TTTATCCTTT
326151 TAAGTTTATC AACATAATTC AAGCTGTTGA TTGCATAGTA GATTAATGAT
326201 ATGAGTATGA TATATAAAAT TCTATTAGCA GCTCAGAGGG TGATTTTAGA
326251 AAAGTAAACA TATTGGAACT AAAGGAAATT GTTTTTGCCA CTGTTTGTTT
326301 TCATGAAATT TTAAAAAAAA GAGCCTACAT AAATGTAACA TGCTGCAAAA
326351 TATGACTATA GAGTCAGAGG TCAGTTAAAA ACAAATGAAG AGATTTGATG

FIGURE 3RRRR

326401 TAAAGTTTAT ATTTCATATG CGTTTTATTT AGTATCCAAA TGAGATTCTC
326451 CCACTTAATA AAATATCAAC ATATGAAAAT AGCAACTCTT TCAATATACT
326501 ATTTCTGAAG CTATATATTT AGATTGCTTC TTTCATTTAT TTTTAGTATA
326551 ATTGTTTTTG AAACTTTAAT AAGGCAAATT AGTAGTTCCT AGTTCTAGAT
326601 AAATGTGAGA ATCATACAGG GAGCCTTTAA AAAGTACTGA TATCTATGAC
326651 CCACACTCAA GAGATTTGGA AGTAATTGAT TTTATAAGTG TTTTGGCTAC
326701 TGGTGTATGT GCAAATCTGC CCAAGTGATC CTTGAGTGCA ATCAGGGTTG
326751 AGAACAATTG AGAGAAATCA AGAGTCATCG ATTCTGAAAT ATGAGACAGT
326801 ACTTTCAAGA TCTTCATGTT GGATTTGATT TTGAAGAACT AACCAAGTAA
326851 AATCATGATT ATTAAAATAA TTCCCCTAAA TAATACTATT ATGCTTATGC
326901 TTTGTTATTA AAGATGGAAG AAGCAGTAAC TATATCTCAT TAGAGAAAAA
326951 ACTAGTGCAT TGTAAGAAAA ATGCATCATT ATGATTTTTT AATTTTCAAA
327001 TTTACAGATT AAAAAAATCA ATGAGTAGAA TACTACCAAA ATGAATGACA
327051 ACAGAAATTT CAAATAATTG CATGGAACAA ATTATTATGG CCCTTAGAAG
327101 AATAGATGCG AGATATGACA ACTTGTGAAG AAGTTTGTCT AGGTGTGGTG
327151 TCAACTTCTA ATCTTCTGTC CTCTGATAAG GGTCAATCTT CCCTGGTTGA
327201 TGAAACTCCC CAGGTTGGGA TTTAATGACA ATTGAGTTCC TTTCAGAGGA
327251 TCTGTCTTTA GGCAGATAAG AGGAATTCAG AGAAAGCCTC TCCCTGCGTT
327301 TGCTGTTTTT CAGGTACTTT CACCTCAGAA TAATCAGTAT ACCAAAGTGG
327351 CATATTGAGA TGGCATATTT TGTTTCCTTG AGAGATGATA CCTAGATGAT
327401 ACATAAAAAC TTGAAAATAC ACGTATTTCA GTTATGCCCA ACAACTAGCA
327451 GGATATGACA CAGTGGCACA ACGCTAACTT TTAAAGTTAG AATACCAGCA
327501 TTCAGAACTT GGCTTTTGAG TTACAAGCGG CGTGAACTTG AGAAAAATCA
327551 CTTAATTTCT GCAAGCTCAT AAATTTCGGC TCCAGTTGAG CTTTCTAATT
327601 CTAGAGCCCA AACCTTACTG ATTGTATTTA AACATAGCTC CTGTTGTTTT
327651 TCTTTGAACC ATCTCCATCT GAAAAACTGG AAAACCATTT TCACTTCAAA
327701 AAATTTTGTT GACACACAAT AAAAAATTGT ACTGAAAGTA GAAATCAGTA
327751 CTAAGAATAT GTTGCAAGAA GTCTACCTCA ATTTTTATTC AGACATTCTT
327801 AAAATATTTA ATACACATTG TAAGAGTCTA TTAGAGCTAT GACTCTCAAA
327851 CTTTAAAGTG TATTCAAGTC ACCCAGGAAT AAATGCAGAT TCTGATTTGC
327901 AATATTTCCT CTGTAACCTG TAATTCTACA GTGCGAACAA GTTTCCCGGT
327951 GATGCCCATA CTGCTGGTTC CTGCTACTGC TGGTTCTTGC ATCTTATTTG
328001 AATGGCAAGA TTAAAAAAAA AAAAAAAGCC AAAAAAGGCC CACAGATTTG
328051 GCTATGTAAG TAAGTAAACT AAGTAGACGC TTTGAAGGAA ATTCAGGATA
328101 AAACTCAACT AGACGCTGGA TTAAATGCCA CACACACACA CACACACACG
328151 CACCAGCAAG TTAAAACCAC AGCAGCAAGC AAGCTATGAG TGGTAAGAAT
328201 AAAATGGTGT TGTCTGAGAT TGAAGCCAAT ATCCATGCTG CATTATATAG
328251 ACGGAGTCTT GGACTTCTAC TAAGGTATTG GATCTAAACC TGAAAGTTCT
328301 ACATTGAAAC AGGAACCCTC AAAGGAGGTT AAAGTGATCT CAATTTGGAA
328351 GTACTCCACA GAGAATCATT TGTACATTTT CTTTCTAAGA AAACATCCCC
328401 AGTTATGCCT TTAGGACTCC CACAGATGAC ATGCAATGAA AGATGAGCTC
328451 CTAAACTACA AGTAACAATA ATTAATGGAG CTAACCTATT ATGAGTCAGC
328501 AAAAGCAAAA ATCAGCAAAT CTAGAGGTGC TAATACCTTA GATATTATAT
328551 AAAATATCTG AAGAACTAAA TGAGAGATGT AATTTTAAAA AGCATGGTAG
328601 AGACTATCAC AATAAGACAG TAAAATCCTT TTAAAAATAA AAAGATAAAA
328651 CTCAACTGCT ATGTTAAACA GTGTATTAGA AAAGGCTGAA TAAAGAAGTG
328701 AAATGGGGCT AGGCATGGGG CTCACACCTG TATCCCAGCA CTTTGGGAGA
328751 CCAAGGTAGG AGGATTGCTT AAGCCCAGGA GTTGGAGAGC AGCCTAGGCA
328801 ACACAGTGAG ACCCCGTCTC TAGAAAAACA ATTAAAGATA AAAAAAATAG
328851 TACTCAAGTA TGGTGGCATG TACCTGTAAT CCCAGCAACT CAAGAGGTTG
328901 AGGTGGGAGG AATGGTTGAG CCTAGGAGAT GGAGGCTACA GTGAGCCATG
328951 ATTACTGTCG ACAGAAAACT TCATAAAGTT TGAATGCAAG TCATACATGC
329001 ATAGAATAGT GTCTTTAAAG TGCTAAGAGA AAATAACCCA TCAATCTAGT
329051 ATTAATTATC CAGCAAAACG ATCTTTAAAG TGTGATGGTT AAATAAAGAT
329101 ACCTTCATAT AAAAATATAA ATTTTAACAC CAATATTTCT TCACTAACAA
329151 AATTCATGAT AGTGTTCTTC AGGAAGATGG TCTATCATAT TGGAAAGAAG
329201 GACACCCTAA AAGAAAATAA CATAAAAATA TGCAAATCTC AATCTCACTC
329251 ATGATTGTAT ATAATAACCT ACCATCAAAA GAATTTCTAC ATCACCTGAA
329301 AAGAATCACA TCCAGATTAT AAGATCCTTT AATATTTAAA AAAATTAAAA
329351 AACAGAAATA TTAGTATGTA AAAGTAATTA AATGTTATAT CTGATAACAT
329401 ACAAATCACA TTTATAAATT CAGTGGGGGG ACAGGTAGCA AAGACTTGTC
329451 ATTTTACAAA TTATTTGGAT GGCTGCAATT TGAAATGCAA TCCTCACTGC
329501 CTATGGTATG TGTTTACAGA GTTCCTGCAT CTTATTCTCC TTGTTTGGAC
329551 CTTAGAGTCT GCCAATTCTT GTACTCCTCC TGCCCCAGAT TGCTTACCAC
329601 ATGTTCCATA GATTTTGATT TTACTTGCCA GGAGTATATG CTAGAGTCAA
329651 ACTGCTTGGA TTCAAGTCTA GATTTGAGCT TTGAACTTGA ACAAATTACT
329701 CTGCCTTTAT CTCAGTTAAC AGACCTGTAA AATGGATATC ATAATTGAGC
329751 CTACAAAACT GAAGCTGTTT TGAGGATTAA GTGAGGTAGT ACATGCTAAT

FIGURE 3SSSS

329801 GCTCATAACA GGGCCTCATA AAAGGAATAT GACAAGTACT CAATATTATT
329851 TTCTTTAGAC CATCAAGTAA TTTATTGATG CCTTTAATAC AAAGAAATTA
329901 AGTTAGCAAA ATCTTTATAA AACTATATTG CTATTTATTG TTTTGAAAAA
329951 AAATTACAGC ATTTGCCAAA TGTGAATAGA GTAGGTCTAG ACATTGGTTT
330001 TACCAACTTG CAGTCCTTTA TCTGTGTCTT CATTAATAAT TTAAACGTGG
330051 CACATATATA CATATGTAAC AAACCTGCAC GTTGTGCACA TGTACCCTAG
330101 TACTTAAAGT ATAATAAAAA TAAAAATAAA TAAATGTAAT TTTTAAAAAT
330151 GTAGAAAAAA ATGTGAGAGA AGGGGTTCAA GATGACTGAC TAGATGCAGC
330201 TATGACGTCC CTCTTCCACA GAAAGGAACC AAAATATCAC ATAAATCTAC
330251 ACAATCAAAT AGGTCTTCCA AGGATATAAC ACTGAAATTT AGCAGAGCAG
330301 ATGACAGGAG GCACCAGGGA TGAAAAGGGA GGAAGCAGAG CTTCCTGCTT
330351 GGACACCAGG ACCATTCTCT GGACCCAAAG CCAAGGTAGT AGGTGAGTGA
330401 AGGAACCCCA GGACTTCATA TTCTAGCTGC AGACTTCTGT TCTAACTACA
330451 GAAGAGTTTT GTGACCACCC TAGACTTCTA GACTGTCTGA GGAAGCTGCT
330501 GGTGACCATG CAGAGCCACT GCTTGAACTC ACACGGACCC CGCTGAGCAA
330551 CTGCAGCAAA GCACAGTTCT GGGAGCCCAT CCCCCAAGGC TCTGCATCCT
330601 GCCCTAAGCT GCTGCTGCTG TATCTGCCAG GCTGAGGAGT GAGCAGGGGT
330651 CCAACACTCT CATGCACCTC AAAGACAGCT TCTACTCCCA TAGTTGTAGA
330701 ACCAAATGCA TTAGAACCAC ATAACCCATG CCTGCCTATC CCTCCCAAGA
330751 CTGCCTGCCT GGTCATTCCT GCAGTGGGGG ACCCACAGCA TAGCAACCAT
330801 TGCTTCATCT GCATGTTTTA GTGGTGGCCT AGGAGTAATT CACCCCTCCC
330851 TATCACAGCC AAAGCTTAAG TCCACCAAGC CAGAGAACAA GTCTGTGGGC
330901 CTGGCCCCAG TCCAGGGGCA TGGAGATCAG ATTTGTAATC TAATCTCAAA
330951 CCAAGGAGGA CCCTCCACTG TCCAAATACA GAAAAGATCA TGGTGTGGGT
331001 CCCTGTTGTG GCATGGGGGC TGAGTGCCCC TCCATTCACG AGAATGGACT
331051 GAGAAGGGTG TGGCCTGATA GTCATGCTAT CTATCACAGA CAGGGATTCT
331101 TGCAGCCTGG AACAGCTCAG GGATCAAAAG GTGGACTGCT TGGGAACTAG
331151 CCTAATTATT CTGGCTACTG CCAGTGGAGA CCCTCTGGAT TTGGGGTGTG
331201 AAACCTAAGT GTGTCCCAGT GCCACCTGAT ATGCTGAAAA CTCTGGGTCA
331251 GTGCTCTTCT CTGAGTGGAC TCTTGGTGCA AGACAGTTGC CTCTGCCCCT
331301 CCCTGGAGGG TTGCCCAAGT GGCCTGGCTG TTGTCCCTAA CCCCATTGTA
331351 ATCAGCATTT GCATTCACCA GGTCACAGGC TTGTCTGACC CAGCCCACTC
331401 AGCTTTGTCA CCTTCAGGCA CCTTGGTGGA ACATTGGACA TGGACCTCAG
331451 AGAGCACCAG GGCCCTGCCC ATTACCAGGG ACACCCCAGA AATTCTCTTG
331501 ATTAACAAAG GGCAAGTAAA AATTTCACTG AAAACAACAC AGCTGCCTCT
331551 CTCCTACAAG CACCACCTAC TGGTGGGGAA GCCAGCCTGC ACATACCATT
331601 ACAACTTCTG ACACCATTGT ATAGCACTAA GCCACTCTTA CTCACAAGTA
331651 CCACCTATGG GCTTGTAGAG TGAACTGCAC AACCCAATAT AATTCCTGCT
331701 GACAGAAGTG CAGGGAACAA GAAAAGCCTC CCAAGACCTT CACCTCCCCA
331751 TCTCTTTAGC AGAAAATGAG CCTGCACACA CTCACAGTAC ACAAGTACTA
331801 AAACCTACAA ATAACCAGCA TTTGAGAAAG CCACTATACT AAGGATATGT
331851 ATAACCAAGG AATTCATACA GAGACTTGGC CCACTAACAG CACAAAGAGG
331901 CAAAGCCAAA GGACCCTACC CAACATGTGC AACACTCCCA CCCTCGGGGG
331951 GAAACAAATC CCTCCCAAAC AAAAGAAAAT TCAAAAGTAA AAGTGGCAGC
332001 TTCTCCAGAT GAGAAGAAAA CAATATAAGA ACTCTGACAC TTAGAAAAAT
332051 CAGTGTTGCG ACACCCCCAA AGGATCACAT TAGGTCTGTA GCAGTGGATC
332101 CTAACCAAAG TACAATTCTA AAATGACAAC GAATTCCAAA TATGAATTGT
332151 AAGGAAGCTC AATGAGATCC AAGAAAACCA ACACAAAGAA ATAAGAAAAA
332201 TTTCCACAAA TGTGGAAAAC CAATACAAAG AAATAAGAAA AAATGATTTA
332251 GGATATGAAA GATGAGATAG CTGTTAAAAA AAAGAGAGTG TCTGGAAATG
332301 AAAAATTCAC TGAGGGAACT TCAAATTACT TTAATTGAAA GCTCTAATAA
332351 TAAACTGTAA AAGACAAAAG AGGTTTTCAG AACTGGAAGG CAAATCTTTT
332401 GAATTAACCT AGTCAGATAA AAATTAGAAA AAAATATATT TAAAAAAAAT
332451 AAACATGACC TTCAAGAAAT ATGAGATTAT GTAAAGCAAC TAAACCTATG
332501 AATAATAAGA AATAAAAGTA AAAGGTTTGG AAAAGTATTT GAGGGAAAAT
332551 TCAGGATAAT TTCCCTGGTC TTGCCAGAGA TGTAGAAATC CAGATACAGA
332601 AAGCCCAGAG AGCATATGGA AGATACTTTA TAAGATGAAC ATCACCAAGG
332651 CATACGGTTA TCAGACTATC CAAAGTGAAC ATGAGAGGAA AAATTTTAAA
332701 AACAGAGAGA AGCATCAAAT CACCTATAAT AGATATCCCA TCAGATTAAC
332751 AGCAGACGTC TCAGGAGAAA CCTTTTAAGC CAGAGATCGA GGCCTATGTT
332801 CAGGTTTCTT AAAGACAAAA AATGCCAGCC CAGAGTTTTA TATTTTGCCA
332851 AAATGAGCTT CATAAATGGA AGAGAAATAA AGTATTTCCC AGACAAGCAA
332901 ATGCTAAGGG AATTTGTCAC TACTAGACTG GCACTACAAG AAGAGCTCAA
332951 AGGAATTCTA AACCTAGAAA CAAAAAGACA ATACTGGTCA TGATAAAGCA
333001 CACATAAGTA CAAAGCTCAC ATCCTATAAA GCAGTTACAC AAATGAGACT
333051 ACAAAGCAAC TAGGTAACAA CATTATGATA GGTACAAAAC CTCACATATC
333101 AATATTAACC TTGAAAATAA ATGGCCAAGG TGCCCCACTT AAAACATATA
333151 GACTGGCAAA TAGGATTAAA AACATAAGAT CCAATCATTT GCTGCCTACA

FIGURE 3TTTT

```
333201 GGAGATCTAC CTAACAAGTA AGGACACCCA CAAATTCAAA GTAAAGGGAT
333251 GGAGAAAGAC ATACCATGCA AGCAAAAAAC AATGATGACC AGGAGTAGCT
333301 ATACATATAT CAGATCAAAC AGACATTAAA TCAACAACAG TAAAAAAGAA
333351 AAGACAAAGA GAATGATGGT TATTAAATAA TGACAAAGGG TTCAATTCAA
333401 CAAGAAGATA TATCTATCCT AGTATATATG TACCCAACAC TGGGGCACAC
333451 AGTATTTATA AAACAAGTAC TAAAGGAAAG GGATATGTAG CCATACAATC
333501 ATAGTGGGGG ATTTTAACAC CCCACTGACA GCACTGGGAG AGATCCTCAA
333551 AGCAGAAAAT CAACAAAGGG CCTCTGGACT TAAACTGGAC TGTAGGCTAA
333601 GTGGATTTAA TAGACATTTA TAGAATGTTC TACCTATCAG CCGCAGAATA
333651 TACGTTTTTC TCACCTGTGC ATGGAAGATT CTCCAAAATT GACCATATGC
333701 TTAGTCATAA AGCAAGCCTC AATAAAATCA AAAAAATAAA AATAATATCA
333751 AGTATCTTTA AGATCTCAGA CCATGGTGGA ATAAAATTAG ACGTCAGTGC
333801 ACGAGGAGAA CACTCAAAAC TACACAAAAA CATGGAAACT AAGCAGATTG
333851 CTTCTGAATG ACTTTTTGGT AAATGATGAA ATTAAATAAC AAATCAAAAA
333901 CTTGAAGGAA AATAGAGATA CAACATATCA AAACCTCTGG GAAATGGCAA
333951 AAGCAGAGCT AAGAGGAAGG TTTATAGTGT AAAATGCCTA CATCAAAAAA
334001 AATACAGAGA ACTGAAATTA ACAACCTAAT ATCGTAACTC AAGGAACTAG
334051 AAAAACAAGA ACAAATCAAA CCCGACACTA GCAGAAGAAC AGAAATAACA
334101 AAGATCAGAG CACAAATAAA TGAGATTGAG ACAAAAAACA AGAAAAAGAT
334151 ACAAAGGATT AACCCTTTTC TGATTTGCCC CAGAATACTT GCTGGTGGTG
334201 CTTGCAGCTG CAGTGTTTGC CCCAAGATAA CTTTGCCATG AAATATCTCA
334251 AGTATATTAT TTTTGCATCA CTCTAATATA TTGACTTTGG AAACAAGACA
334301 TCATTCTATT TATAGTGTTC TGTTTTTAGT GGTGGTATTT CCATTTACAA
334351 ACGATAGTAA GTCTTGATGG CTAAAAAGTC AAATCCTAGA AAACAGCATT
334401 CCTTTCCGTG ATGTTAACAT CATTCTTGAA CAGTTGTTGA TCAAAGATTC
334451 ATTTGTTGAA TACAATTTTT CCAAAATAGA CAATTCTGAT AATTCAGATG
334501 ATTCTGATGT TAGTTCTGCT TAGAAATAAC AACAAGAACA GTTTTTATAT
334551 TTTATTTTCA CATTAAAAAT CTGTAAGATT TGCTTCAGGC TCAAAGAGTG
334601 TGTTTATGTA AAATTTAATG AGCACTGGCA GCAAGCTGTG CTTTTGGGTT
334651 AATGAAATAA AAGGTTGGCT CTTAGGAAAC CATAAGCAAA ATTGATAGAC
334701 TGCTAGCTCA ATTAACCAAG AAAATAAGAG AGATTTAAAT AAGCACAATC
334751 ACAAATGATA AAAGTGACAT TACACAGAAA TACAAAACAT CATCAGAGAC
334801 TACTACTAGT ATGTCTTTGT GTGTAAACTA GAAAACCTAG AGGAAACAGG
334851 TAAATTTCTG GAAACATACA ACTTCCCAAG GTTGAACCAT GAAGAAATAG
334901 AAATCCTGAA CAAACCAATA ATAAGTAATG AAATTGAGTC AGTAATAAAA
334951 CATCTTCCAA CAAAAGAAAA GCCCCAGACC AAATGGATTC ACAGCCCAAT
335001 CTTACCAGAC TATCTATCTC AATAGACACA GAAAAAGCAT TCAATAAAAT
335051 TCAAAATCTC TTTACAATAA AAACCCTCAA CAAAGTAGAC ATTGAAGGAA
335101 TAGCCTTCAA AGTAATAAAA GCCATCTATG ATGAACTCAC AGAGAACATC
335151 ATACTGAATT GAGAAAAGCT GAAATAATTT CCTCTGAGAA CCGGAAGAAG
335201 ACAAGGATGC CCACTGTCAC CACTCCTATT CAACATAGTA CTGGATTCCT
335251 AGCCAGAGAA GTTAGGCAAG AGAAAGTAAG AAAAGGCAGC CAAATTGGAA
335301 AAGAGGAAGT CCAACTTTCT ATGCTCATCA ATTACATGAA AAATGACTTC
335351 AGTATCAATA TACAAAAATT AGTAAGATTT CCATACATCA ATAATTTTCA
335401 AGCTGAGAAC CAAATCAATA ACACAATCTC ATTAACAATA GACACACACA
335451 CACACACCAA ATACCTAGGA ATATATTTAA CAAAGGAAGT CAAAGATCTC
335501 TACAATGTTC ACTGTTTGAG TGATGGGCAC CTAGAACCCC AAACTTCACC
335551 ATTATGGGAT ATATTCATGT AACAAGCCTG TGCCTACACC CCCTGAATCT
335601 ATAAAAATAA TAATAACAGA AAACTATATG CATTATGTTC TCACAATTGT
335651 TAGAAACCAT GTGATAACTT CCTTAAAAAC ATGAAATGCC GTATTTACAA
335701 AGTCAATTTT TAGATACTGC CTAAAGTTGG TTATAGATTG TACCATATCT
335751 GTATTCTCTT ATGTTGATCC AGCAAAAGTA GGAGGTTTTC CTTCTGTCGT
335801 TTTCCAAATG TTGGTCAGAA TCTAATATAT CATCTGGAGA GGGTGTTATG
335851 AATGCTTATA CAACTACCTC AATCTTGCTA AACATGAGAT AGTAAAGTAA
335901 TTGTTTCCAT AAGTTCACCA AAAACTGGTA TAATCAAGAA GCAATATATA
335951 GTATTATTGT TATTCCCCAG GGTCAATGGC TTCCTTCATG TTGTATGATT
336001 CCAGAGTTTT CTTGTATCCC ATCACCAATA AGTTTTGTAG AACTGTCAAC
336051 CCAATAACAA ACAGAGGGGG AGACTCCTTT TTTAAGAGAT AATGGTCTTT
336101 TAGGAGGAAT AGGCATTGCA GTGAGAATAT GAGTACCATT GTAAGCTATG
336151 TGTGTATTCA GGGAGGTAAA ATAAAACAAA GGTTTTTAAA GGAAAAATGA
336201 GGATTACATA ATTGTTTTGA GATAATTCTC AACTGTCTAG GGAGTTGCTA
336251 GACAGACGTC CTGGCAGATG TATATTTTGT GTAAGGTTAT AATGACCTTT
336301 GTGCAAGGTT GTGGTTTTTG CAGTCTCCGT GATAGTTATT TTTATCAAGC
336351 ATTTGTGTAT AACAACCCTC CCTTAATTTC ATGGCCTTCC CTGGCTCTGT
336401 TTGTGAGGAT CTTTAACATA AGTGACTCTA TTTTGATTTT GACAACTTTC
336451 ACAGAACTTT CCATTTTTGT CAGCAGGGTT AGTATAGGTA TACTAATTAT
336501 TGCTTTAATT TAAATTTCCT TCATCAAAAA GAAGTTTGAG TATCTTTTCC
336551 TTTTGGAATT GTTTATCTCT ATATTTTCTG TTAATATAAT TTACACATTT
```

FIGURE 3UUUU

336601 AAAATTTATT TATATTTACA ACTTTACAAT TATATGGATC AATAGGGCTT
336651 ATAACAAAAA GAAAGAAATT CCTATGCACC CCAGCTCATT TTTTACCATA
336701 TTCCTCAGAG GCAATTAGTT TCTCTTTTTT AGCTTTTTTT TTTTCATCTG
336751 TTCATATCTA AATAAAATTC ATACACTGCA ATCTTAATTT TAGACATTAC
336801 ATATATTGGT AGATTAATAT ATTTAGCTAA CTTCCATGCT CCTATTCAAT
336851 ATTTCTGTTG CTACACCACT GTAAATATTG TTCACTGCTG GGAAATAAAA
336901 TGTACATTGA AATAAAAATG TTTTTTCTTC TACAGTGATT TTATCTTAAA
336951 ATTAATAATC TTCATTACGT CTTTCTTAGT GTGCTTAATT TTCTTTAAAA
337001 TATAAGAGTA ACTTTTCTAA TATATCTTAT ACTCTATATT TTAATAAATT
337051 TTTTCATACA GCTAAATGTC TCATATGATT TGTATCTTTC TTTTCTCCTC
337101 TGTACATTTT TCTTCTGTGG TTCTCATCTT GTCTTTGGTT TTGTTTCTTT
337151 CTTAATGTCT GCTGCACAGT TTTTGTCCTG AGACTTCCTT TTGCTTATTC
337201 TTGAATTTCT TCTGCCTTTT TCTTATGTGA AATCCCATTT AGTAATTATT
337251 TTCTATCAAT GCGCTCCTAT TTTATGGACT ACATCTCCTC AAAGCTTCTT
337301 GAGCTCTTCA GAAAAATGGT ATAGAATATA AGTATTTAAA CTCTTTGCAT
337351 ATCCGTGTCT GTGTATATAT AGAACTGTAT ATTTAATATA GAGTAAAAAA
337401 AATCCCTTTA ACTTCATATT AAGGTAATTT TTTCCTTAAA TTTTATTTTA
337451 CTATGTATAT TAATAATACA TGTCAAATAA AACTATATTG ACAGATGTAC
337501 AATGAAATAT AACTCTTTCT AAAGTTTTAA CACAAGAGAA CTTACTCTAA
337551 TTTTTCTACA TCTGTTTATC ATACTTTATA TTATGGTCAA TATTTTGTAT
337601 ATATTCTATA CTTTCAGATT TGATTTTCTG CTTGACCCAA ATGGGCTGTA
337651 TTTTTCTTCC TTTAAATCAG GAATATTTTT AATATCCAAA ATGTATCTTT
337701 AAACTTTTTA GTTTCTTCTT TTCCTCACAT TTTTTAAAAA ATTTTTATTT
337751 CTCTTGATTT TCCTAGTTTA AATTTTAAAA TACCTTATTT ACCTTTAGGA
337801 AATGACAACA GTTAAAAAAA AAAACATTTT AATGCATTGT GCTAACATCC
337851 TATTTCATGT TTATTTTACT ACTTCTTATT TTTACAACGG GAAAATGTTT
337901 TAAATCATTT GTCATTGAAA GAATTTGACA ATTCTCAATG AGTCTTGAAA
337951 TTCTACTGCA TAGGTTTTTT ATTTTGTGTC ATACCACATT TATTGAAGGA
338001 TTTATTTTTA AATATGAAGT TTTTTTACTA GCTAAAATAA ATAGAGAAAA
338051 ATTATTTTGT ATTTTTACAA AGTGTTTTGG GTGCAACGTG TAGCTTAAGA
338101 GATAGCAAAA TGCATCATAT AATGAGTTGA GCACTTTCCA ACTTCAAGAA
338151 TGTATTGGTT ATAAAATTCT TGTCGCCAAA GTATCTAGTA TTCATATTTA
338201 CCTATGAATT TTTTCATAGA GTATTCTTAA TATTTTTAAA TTGGTCCATT
338251 CTCATGTATT AGCAAATTTA CCCCCAAATG ACATACACAC TGCCATATTT
338301 TTATTTGAAA CTAAATGACT ACCATATTAT TTGATTGCTC CTTTTAAATT
338351 ATACAATATT GCCATCCTAT GAAAAATTAT TTTAGAATAA AGTACTAATT
338401 TTAACTGACT TCTCTGTAGC TTTAGTAGTG TTGGTCTTTC TCTCATTTTA
338451 TAACCTCTGT CCTTGAATAT TGAAGCCTGC ATCCTAGTTT CCATGACAAA
338501 GTTTTCTTGA TTTTATTCTA TCCTTCCTTG ACATTCTTTC TTAGTGTAGT
338551 TTTCTCTGTA GTTTACCTGC ACTCATTAAT TAAATGTGAA TGTTTCTGAG
338601 AGTTCCAAAA ACAGCCTCTC ATTCTCTTTG CTGCTGGAGA ATATCACTTA
338651 GTTCTATTAT TTCCAATACT CTCTGTATGA TAATGTCTCC CAAACCATAT
338701 CCCTAGCATC TCTCTCCTTA ACTCTTGTTT CCAATAATCA TAAGACTATT
338751 GGGCATCTCT ACATTATTTC CTCAGACTCA GGCATCTCAA CCCAAACTCT
338801 TCAAAACTGA AAGATTTTCA CAGCTTCCAA CCTTCTTAAT CCATGACTCT
338851 TGTACTCTCT ATATTAGGTA ACTCACACCA ATAGCTACCT TATCAACTAA
338901 GCAGAAATTT TAAAATGATG CCTCCTCTTC TTTTTAAAAA ATTTTTCATG
338951 TTCAATTTTA TGCATGTCCT TTAGATTCTA CCTTTCTTTG AAAACTCTTC
339001 TTTATCTTTA GTTGATAATC TTGTTATTTT GTCTTGATTA TACTAACAGC
339051 TTTCTAATTG TTTCCCACTT CTAATTCCTT TTACCTCCAG TTCATTCTCT
339101 GCACTACTGC CAGAATACTC TCTAAAATGC AAAGATGTTT AAAAAGAAAT
339151 GAAAAGAAAA ATAATTACAA TGTGTGGAGT GATGTAAATT GCTCTTTTAA
339201 TTAAAAAAAT AAATTTTAAA ATGCAAATCT TATTTGTCAT GCTCTTCCTT
339251 GAAATCAGTA GGGAAAATAA TCCTCTTTTA ACTTCCCATC CTCAACTCAA
339301 AAATTGAAAA GATGTTGGCA AAGCACGCTG GCATCATATG CTCAAACCAC
339351 ACTATATAGC ATTTTCCTCC TTTACCTAAA TTTTCCTTTG CCCACCTCTC
339401 CCCCAGTGAA ACATAACTCT TTCTACAGAA TTTATCTTGG ATATTACCTC
339451 TTCTGCCTGA GCAGATATAT TTTACACAGC TTTCTGATAG AATGAAATGC
339501 AGCTAATATT TATAAAAATA ACGAGATTCA TTTGGGCACA TCTAATTTTG
339551 TATAGTCATG AATGTCGGCC TTTGGAGGCC TTATGGTCAA GACATGTCTC
339601 AGACATTAAC CCCCCATGCA GTTCACTGTG CTCTGTATGA TAATTTTATG
339651 TTTACTTGAC TTTTTTCCTT TCTTAACTAT GTCCTCCTGA GAGGAAAGGA
339701 ACCACATTTT TTTTTTCTGC AAAGCACAAT GCCAGTCACA AAGTGGCACT
339751 ACTTACTGAT TTAATAAATG AATCTCATCT TGATTACTTT TCTTGTTATA
339801 AAGGTGTTTA ACTAGTGGAG AAAATTGTAT TAAGTCTTTC TGGAAGTACA
339851 ATGTCCTCCT TTTAGTAAAT AAATATAATG TTTATTTATT TAATTGAGTG
339901 ATTAGTGGTG CAACAATTAT ACATAGGAAA AACTATAAAA ACATTCATTA
339951 AATTGGTAGT ATTAAAAAGC AAATTGTGCA AACCCAGACT GGGAGATGTT

FIGURE 3VVVV

340001 CTGCAGCATA TCTGGTCAGT ACACCCTAAG ACTGTCAAGG TCATAAAAAT
340051 CAAGGAAAGA CAGTAACTGT CACAGACTCG GGGTGATAAC AACTAAAGCA
340101 TTGTGGTATT CTGGATTCAG TACTAGAAAA GAAACTGGAA AACCGGTGAA
340151 ATGCAAATAA AGTTTAAAAT TTAGATAATG GTAATGCGAT AATATCCATT
340201 TTTTAGTTTT GACAAATGTA ATATGATAAT GTACAATGTT AACAATATGG
340251 GAAACTAGGT GAGGGGTATA TAAGAACTCT AATCTTTGCA TATTTTTTGT
340301 ATATCTAAAA TTATTCAAAT CTAAAGTTTA TTTATAAAAA TGCATTTATG
340351 ACTTAACAAA AATTTTATTG TTAACACAGC ATAATATACA GGTTTTTTAA
340401 ACCATATGCA CCCAGAGACA CTTGTAATGA AAGTGTACTT CATATCTTTA
340451 AAATGCACAT CTTAGGTTGG TCACATGGCT TATGCATGTA ATCCCAGCAC
340501 GTTGGGAGGC TGAGGCAGAA AGATTGCTTG AGGCCAGGAG TTCAAGACCA
340551 GCCTGGACAA CACAGCAAGA CTCCATTTCT ACAAAATAAA AATTAAAAAT
340601 TGGTTGGATG TGGTGGCATG CCCCTGTAGT CCTAGCCTCT CAGGAGGCTG
340651 AAGAGGGAGG ATCATTAAGC CCGGGAATTC AAGGCTGCAG CTACAATTAT
340701 GCCACTGTAT TCCAGCCTGG GCAATCAGAG TGAGACCTTG TCTTGAAAAA
340751 AATGCATATC TTTTTCAAAA ATTTGAGGGA AAGTTAGAAT AATTGTTTAA
340801 AAATGCACAT TTCCTTTTAA TATATGCTAC TTGCTATAAT ATTGGTTTTG
340851 ATTTGAGATG ATGCGAATGC TTTTATGATC ACACTACTGT GTTAATTCTC
340901 TATTTTATAT TAAAATTTTA AAAAATTATA TCTAAAATGA TTTTGCCAAA
340951 AATGTTGCAT AGAACTCTGA CCTTGAAATC AATAGAAATT TAAACTCACT
341001 TTTGTCTGTC TGGATATTAT GGACCATTTT CAATTTTTAT ATTTAAAAAC
341051 CCCTCACAGC AAAATATGTT CTAGCAATTG ATCTTTTTAT CTATTACAAA
341101 AATGAAACAT TCCATTTCCT TATATCAGGG AACACATTTG AGGGGTGGGC
341151 AAGCATACGT TTGTTTCTTC CTTTCATTAA TGTTTTGCTG GAGGGCAAAT
341201 GTCAGAGTAG CCACTTTCAT ATTTTGGCCC CTCTTGCTGA AACTCCTGTA
341251 GGGAAATTCT GCAGATGGGT TTCTTTGATG GTTCTTTTCA TTTTTATCTC
341301 ACGCTGTGAC TTTGACAGTC AGACTGGCAG TAGGATACAG AAATAAAAGA
341351 AGAAGGCTTA AAGAAATGTT ATAGCTTCAT GCTGTGAATT TAGAAGATGA
341401 CAGGTTTTTT TGGCTTGCTT TCTCTGGCCC ATGACTAAAA GAACTGTCAC
341451 TAGGTTACAG TGCTAAGAAG AAGTAATGAG AACATATTTT CATGCAGATA
341501 CCTAGAGGAC TTTGATGCAC ATGGCCTGCC CAAGTCAATC GGAAACTCTG
341551 AGGCTAAAAA TTGCTGTGGC AGGATCCAAA ACCACATGGC TGAGAAGGAT
341601 GCTTGGCAAT CGTGTTTGTA CAGTTTTACA CAGTTGACAT GTAATAAGCA
341651 TTTATTAATA ATAATGACAT GTAAATTTGC CTTTCATGCT GTTGCAGCAA
341701 GAATCTATCA TCTGTCAGTT TGTCTGTCTC CACTGTATAA TATATATAAA
341751 GAATATATTC CTTAAAGTAA TGATGAATCA GTATGCTGAA TGTGACCTTA
341801 TTATTTTTTT GTAGAAAGGT GTCTCCAAGG CTTTGTTAAG CAGCAAGGGA
341851 TTACATTTCC ACTAATGAGA ATCCTTAGGG CTATGCAATA GTAATATTTC
341901 TAATTGAGAA ACTCAAAAAT TGCATGTGAA AAAACTTTAA AACATGAATT
341951 CTATATGTTT ATAACAAATC TTAAGAAATA TGTAAAAGTA AAATCACTTA
342001 AAAATAAGGA AGAATCAACC TGTGATGGTT GTAAGATGGT CAAATTTATT
342051 ATCATTTTAA GTACAAACTT ATTTTTAGAT ATGATATGCC TAATTTTTAA
342101 AGAGTATGTA TTATAATGTA TTATAATACA TATAATACAT TATATGCATT
342151 ATATATAATA TATATAAAAA ACAGATTTTG TCAGGATACT AGAAACTCTC
342201 TCTAGAAAGG TTTTAAGCTC TATTAATTTA ACTTACTGAA TTCTATGAAT
342251 TTAACTCCCA TCCTTGAGAA AAGTCCAGAA GTGTTACATT CTGACTTACA
342301 GTTCATTCTT GTAGGAAGTC AACATTTCCT TCCTAAGTTA TGATGAGCTT
342351 TGGTGTAGAT GCAATAAAGT AATTATTCTT TCTGTTTGTG TTGAGAAGAT
342401 GTAATATAAC AAAAAAATCC TGTTCTAGTT AAAAAATTGA TCTTCAGACT
342451 AAATTAAACC ACAGAAACCT GCCATGAATA CAGTGATTAT TTGAGAGGAA
342501 TTTTCACTAC CACCTCCTAA GTCAGGCCAT CTCTATTGGG AGACAATTCT
342551 CTATTGATAA TGTTTCTATA TATCATCTAA GTTTCCTTTG TTTCGGGCTT
342601 TTTTGAAGAC GTTTGTATAG CTAACAGCCT TTTACAAAAG AGATAGTGTC
342651 TTCCTGTAGA GTAAAGGACA TGTTTGCTTA CAGTACAGTA AAATAAAATC
342701 AATGTCTTAC TCTGCAGCAA CGTTTAGGCT ACCTTACCTT TTTAACCTAG
342751 CTTTGACCTG TTACAAAAGA TTCTAATTCT GCAAGCTCAG GGTTCCGCCC
342801 CTGTTCCTCA GTCCACTAAG TATGCACCTG TCTCTGTGGT AATTGGGACT
342851 TGGGAAAACA ACGTGGGTGC TGATACTCTG GTTGCCTTTA TAACTGTGAG
342901 TAATGAAGTT ATTTGTCTCT GATCCAGGGA TCTCATGTCT TCTCCCAATG
342951 TTCATGAGAC TACAATAGCC TAATATGTAA GCTTGAAAGC AGTATAAATC
343001 TCAGTTCCTT CACAGTTCTT GGTGCTCACC TCCCTTTTCC TTATTTGTAG
343051 AAAGTGTTTT CTTTTTAGCC TCTCCTCCTC TAATTTCTAA TCTCTTTAAT
343101 TCTTCATAAT ATGCCACTGT CTGGTTATTC ATTCTAATGT TCACTTCTGA
343151 GCCAAATCTC ATGACTACCA ATTTTTTATT GGTTAAAGTT TAAACTTTAA
343201 TTAATTCACT AATTCATTCA TTTATCAGAT TTTTTAAAGT ATTTACTATT
343251 TACTACTTAG GCACTTGAGA TAAATGGTGA AGAAGTTAGT CATGGAATAC
343301 TACATAGAAG TCTCCAGTAT TGGCTTTCTG TACATTCCTT GTCTCATCTT
343351 ATACTATTGT CTTCAAAGAA CCTATGCCCC AGCAAACTTG ATTGAGCCTC

FIGURE 3WWWW

343401 GAAATAGGCC CTGTTATTCT CCAAGCCTGT ACTTTTATCT ATTCCTAAAA
343451 TACTCTGCTT CTGGATCTCC ATCAATTAAA AATGAGTCTA TGCATTATAG
343501 CTTCATTTTA AGTATGATTT CTTTGTAGTT TTTCCTTTTT AACTCCACTT
343551 AGAAGTGATC TTTTGTCTCC TTTCATATGA TACTCACATA TATTGTAATC
343601 ATTGAATGCA TTCCTTAATT CTGTACCAAA CAATGGCAAT TTGAGGAAAT
343651 ATAAAATGTT TTGCATAATT TTTGTGTTTT ACAGTGCCTT ATACATAGTA
343701 GGTAATCAAT AAAACTAGAA TAAGACAGTA AATACAGATA TGAGAAGCAC
343751 CCAAAGCCAA GCCAAGTCAA CCAAATTCAA TTGATAGAGT TTCTTTCTTC
343801 CTTCAGAGCT GGCCATTTGA GCATCAGCAC ACACCATCAA CATAGGATCT
343851 GATGGTCTGA GTTTAACACT ATCTGGGTCT TAGTGGCCCC ATTTTTAATA
343901 ACTAGGTAAA GAATATAATT ATATTTTGTG CCTTACTGTG AGATGCTTCA
343951 GAGTTCCTGA CAAATAATAA ATAACCTGAA ACATAAATCT AGACTATGAA
344001 ATTATTATTA CTTGAAAATT TAATGTGAAA AATAAAATAA TTATTTCATT
344051 TTCACTTTAA TACAATAAAT CTAACTTTGT GGCATCATGA AAATTTCTAT
344101 AATTTATACT GGTAATAATA TATGATTATA TTATTTTAAA TCAGTATTAA
344151 GTATGTATCG TAGTAATTAT ATAGTACTTT TATATAATCA TATTTAGCGT
344201 TTTTATTAAT AAATGGAATT TACTGAGTGC TTATTATGTG TCATGCATTC
344251 TGCTTAATGG TTTACATACA GTAACTTCAA GAGGTAGATA TTATTATTTC
344301 CATGTGTGAT GTGGGAAGAG AAATTAAAGT CAAGAAATGT TACGTAACAT
344351 GCCTGGGGAC ATAAGTAACC TTTAAAATTA ATGGCCATAA TGACTGAGAA
344401 ACGGGATGCC AAAAATCAGG CTTTAGTTGG AGATTATACT CCTGTACAAA
344451 GTTTGTGTTT CACTAAGTGC AATGTCTGAC AAGAAGAGCA GAGGAAAGTT
344501 ATACTAATAC ATTGTTTAGG GTTGTTTCTA CCAAGGATTT TAGAATCAGG
344551 GAATAAAAAT AATAATAGAG TTTATATTAA CAGGTGGAGA TAAAATTCAC
344601 TTCTGCAACA GCTCTGTTCC TTTAGCATTT TATAATAAAA ATTATTTATG
344651 TGAAAAAGTT GATGACAGTA AAACCATTGC AAGTATAAAC TAATATTATT
344701 ATTAATAAAT AATATATATT AAATATTTTA TATTAGTAAT TTTAGATACT
344751 TGAAAAGAAA GGAAAATATT ACAGAACTAA CACTGAAATG CATAGAGGAG
344801 CAAAATTAAA TTATTGTCAT TATCTCTGGT TTCTACTAAG GGAAGATTCT
344851 GTGTGTTCAA TAATATGCAG AATTAGACTT TCCATCTTGC TTTGACCGAG
344901 GATTCAGCAT TTACTTAATA CTTATTATCC TTTACTTCAG TTTGGCTGCA
344951 CAACTAAAGT ATTCTTAAAG CCAACAATGA GAATGGTCTT AATGATTACT
345001 TCTTTTCATT GCCCATTTTT GTCCTTCTAC AGTAAGAGGG CAATAAGAAG
345051 GAAAGCCAAC TCAATGTCTT TTTCTTCTCA TGTGAGACAA AGACAGGGAA
345101 TTCTAGGATT GATAATTAAA GCCATCCCTG AGCAGCATTT TCGTTAATTA
345151 CTCTTATCCT ATGAATTCTC TTCTATTAAA ACATTATCTG CCTTGTATTT
345201 CATCATGCTA TCATGATGCT TTCCTGGTGG CTTTAGAGTT GTACTAGTTA
345251 AAAGGGTCAT TATCATCTAA TAATCATTCT GAGAACCTAA ATAGGCACAG
345301 GTAATAAAGG GTCACCTCTG TTATACCTAG TAAAAATGTT AAACTAGTGA
345351 ACTCCAGCAT ACAAAAAGAA AGACTGAGTT TAATTAATAT ATTGTATATA
345401 TTGTGTACCT ATAACTCTGT CAGTTAGACA GCTGGTTTAA ATATCTCTTA
345451 TGTACACTGT TCTTCATGGA AAGTCAATGC TTATAACTTC TGATAAGATC
345501 AACATCAATA TATAGCTTTG GTATATCACA ATTTTTTTCA AAGTGCTTGA
345551 GAAGCATTAA ATAACTGATT AGAAATGTAA TTCTGGTCCA TCAAATTATG
345601 ATTCGATAAT AGTTTAAACA AAAAAAATCC ATTCCTTCCA TTTTACCCAC
345651 TATAATGAAA TTACTCCTTG TCATCATTCA ACCTTGTATT TTCAAAACGG
345701 TTATTAATAT AAAAGCAAAG TGATGCCTTT GGAAACGTTT TCTGAACACA
345751 ACATGAATCA CTTTCTAAAA AATTACAATA TGCATATTTT AAATAAGTAA
345801 TCTACATAGG ATCCAACTTT CAAGCATAAT TGGTATTTGA TGAATGTTTG
345851 TTGAATACAA ATCTCAGTAA TAGAGCTCCA GGGACTAAAA AAACATAGTT
345901 ACCTAACATT TTTTTTTCCT TAAAACTTCT GGGAATAATT GATATCTAAT
345951 AAAATGTTAT TTATTTACAC CTAAATGTAA TTGATTGTGC CATGTGGAAT
346001 TTCATTAGAT TGTATGGACC CTTCCTACTA TGAGAGCAAC TTTTATATGA
346051 AGCAATACTG CATGTGATCA AAATTAAACT TCCACTCCTG GCCCCATCAG
346101 AAATTCCAAT ATGGTCAATT ACAGTGAACA CTGATACTTC CTAAAAATAT
346151 GGCAAACTTC GGCTGAGTGC AGTGGGTCGC TCCTATAATC CCAGCACTTT
346201 GGGAGGCTGA GGCAGGAGGA TCACCTGATG TCAGGAGTTC GAAACCAGCC
346251 TGCCCAACAT GGCGAAATCC CATCTCTACT GAAAATACAA AATTAGCCCA
346301 GTGTGGTGGT GCCTGCCTGT AATCCCAGCT ACTCAGGAGG CTGAGGCAGG
346351 AGAATCGCTC AAATCCAGTA GATGGAGGTT GCAGCGAGCC GAGATCATGC
346401 CATTGCACCC CAGCCTGGGC AACAAGAGCT AAACACTGTC TCAAAAAAAA
346451 AAAAAAAATA TCAGTCTTTG ATGGAAACTA TTAGGGCACT GATACATCCA
346501 AATTTGCATA TATTGGGAAG ATATGTCTCG TCTTTTTCTT TAAACAATAA
346551 TTAATGAATT TTTATTTTCA TTTTCTTCCC CTATGTATAT TTCTACTATG
346601 TACCCTTTAA AATTTGTTTA TTTTCTTTTA AATTGGCAAA TAATAATTAT
346651 ATATACTTGT GAGGTACAAA GCGATGTTTT GGTATATTTC CACATTATGA
346701 AATGATTAAA CCAAGTTCAT TAACATATCC ATCACCTCAC ATAATTAACA
346751 TATTTTTATG ATTCAAACAT TTCAAATCTC TCTTGGAAAT GTTATAATAT

FIGURE 3XXXX

346801 ACATTACATT ATTAGTAACT GTAGTCACTG TGCTGTGCAA GAGATCTCAA
346851 AAATGTATTC CCTGTGTCTG AAACTTTGTA CCCTTTGTCC AGCATTTTCC
346901 CCTTCCTCCA CCTTTAAAAA CATTTTATTG CTTGTGTAAT AATGCTATAA
346951 CATTTATAGT ACAACATTGA CTACTATTAT GCATCTGTTT ACTCAGATTT
347001 TGTGAACATT TAACTCACTC TATTTTTTTG AAAAGGCTGG TTACACCTTC
347051 AAAAACAACC CTCATTTGTG CCCTCTAGAC TGTCTGTTCA AGACACAGTG
347101 ATGAAATTAT ATCAGATGAA AGATGCCAGA GCCATCTCAA TTAGTTTAAT
347151 TGACTAAAAT ATGCATACTT TATTCACATT TTAGACCACA TTCATCTGAA
347201 TATATAAATT AGATGGTTAT GTAAAGAAAC CAACCTAGCT GTTTGTATGA
347251 CTTAGGTAAA ATAAAGATTA TATTGTATCA CAGTTTTCTA TACATTTTCT
347301 AGGGAATTCC AACACTTTGA AGCTTCTATA TTATGTGGGG TTTTTTTGCA
347351 ATAGCTAAGA GATAATTAGA AGATCAATCT TTTTCTTATC TTAAAAATAG
347401 AATATGTAAA CATTAAGTAA TTATTATTTT AAAATGTCAA GAAAGGCAAT
347451 ATTGAGGAAA GAAAAGAAAA TTTCAACATT TAATGTTCTA TTTTACAATA
347501 CTAAATGAGG TTCTCTTTTC TGTTAGAGTG AAAGAACCTC AGACCAAAAC
347551 CCCTCAAAAA ATGGATTCTG TTCTTTTGCC GTAGCTGTAC AGAATCTTCC
347601 AGAAGTCATT CAGTTTCTCT GAGACCCATC CTAATCATTG AAAAAGAGTA
347651 CAGTTATGCT CTTCCCAAAT ACCTGAATGT TTGTCAGTAC ACTTCATGAC
347701 AAATAATGAA TATTGCTAAA TACAAAAATA TGGTAATTCT GTGTATTAGT
347751 TTGTTGCAGT TGCATAACAG ATAATCACCA ATTTAGCAAC TTGAAATACA
347801 AATTTATTAA CCCACAGTCT TTTTACCCCA GATCCAGGTT GACTTGACTG
347851 ACATCATTGT TCTGAGTTTT ATAAGGCTGA AACTTAAGTG TCATCTGTCT
347901 TGGGTTTTAC TAGGAAGCTC TGGGGAGAAT CTGCTTCCAA GCTCATTTGA
347951 GTTGTTGGTA GAATTACTTC CCTGTGGTTG TAGGAATGAG GTCCTGTGAA
348001 CCTGCTGGCT GTCATCCAGG GACCAATTTT AGCTCCTCGA GGACTCCCAG
348051 GCCCTTGCAT GTGGGTTCCT ACATCTCAGA GCCAGCAACA CCACACATAT
348101 CCTTTTCAAA CTTGGAGTTT CTCAACTGCC CCTGCAGCCA CCTCTCCCTT
348151 CAAGAGGTAA ATGAAGCCAC CTCTTCTACT CCATCTCTCT TCTGCTTCTG
348201 GTTAGAAACA GCTCTCTGCT CATAAGGGCT CCTGTGAATA GACTAGGCCA
348251 ACCAAGATGG ATAATCCAGA ATAATCTCCC TATATTAAGG TCTGTAACCT
348301 TAATTATATC TGCAAAGTCC CTTTTGCCAT ATAAGGTAAT GTTTTCACAG
348351 GTTCCAACCT CATACCATAA TACAAATGTG AAGTTATTTT ATCAGCTCTG
348401 TAAATGGATA TAGAAGAATG AGCTTGGAAA ATTGAAATAA TACTGGTCAG
348451 AGTCAAGGGA GTGTTCATGT TAAGACTGGA GTGACTAAAT AGTCTTTTAA
348501 ATCAGATGTG GGTTTGATCC AGAATCTGAT CAGAATGCAG GAAGGAAAGG
348551 GACCTGTGTG GTAAATGGCC ATACCTGAAG CAGATTTCAT ATTGAAGAAT
348601 AATTATTAAA ATTTTAGATA CAAATAAATA TACTTAACAA AATTTCTCCA
348651 AAAATGTAAT TTAATAAAAT CAATGTTAGG CAGATTAATA TGAATGTGCT
348701 ATATCTTATC TGTAATAATT TACCTTGATT AACAGAGCTA TTGATCTCAA
348751 TTTAAAACAA CCCTGATTAG ATTGGTCAGT AGATTGTTTA GTGCAGAATA
348801 TCAGAGATAC AATGAAAAAA AATTAATAAA ATTTATTCAT TAGCAGATAA
348851 AAGTTATAGC TGAAACTACA TTTATGCAGT TATGACACAG GCAAATTTGC
348901 TTCCATATAG TTTTTAGTTA CTCTGGCATT AACATAAATG CTGTATGCTT
348951 GATATTTTAA GTTATATGAT GGAGAAAAGG TCATCTGCAC TTTTTACAAT
349001 TTAAGAACAT TGCTTGTTTT ACTCTTAACC TCTTTTTAAT GTCAGTTTAA
349051 TATTTTCTTC TATTTGAGGA AGGGACTAAA TAGGGGGCCA TTTCAATATA
349101 GGTATTCCAG TGTTTGAAAA TGTATCCCTA TTCTCAAACA CATTTGAAAT
349151 ATACTTTTTT GGTTAAAGGT GAAGAATTTA TATTAAATGA AAAAATTAGT
349201 AATTGAATTT AAGAAGAAAA CCAACTATGT GGTTATTATT TAGCACAGCA
349251 ACTTTTAGAG TTACCACCAT TCTTGCTTAA GAAGTACAGT TTCATATTGA
349301 AGAAGAGTAG AGCTTATTTT TGAGGTATAA AAAGTCATAT ATCTGTTGTA
349351 GGGGATCTGA ATGCCTCAGT ATCTGTGAAG TAACCTTTAT AGAGAAAGGA
349401 TTAAGTGTTA GTGTTTTCAT GAAGTGCTTC AATCTTAGTA AGTTTAACTT
349451 TATTTTGTCA CAAACATGTC ACCATGAAGA TTAAGAAGTT TGTTTTATTG
349501 TTATCCTGAG CATTTGTCTT TATGAAATAA CTTATATTCT TATTAAAGTT
349551 TCCAAATGGT GGGAAATAGT ACATTCTATT GCTTCCAGAT ATTATCTGTT
349601 TTAAGCACTA TTATATAATG AATTTCCAGA GGTTATTTTT GTGGTTATTG
349651 TTTTCTTTTG GTATAATTTG CTAGAAGAGT CAATATATAC CTGAAATAAT
349701 ATTTCTACTT AGCAGTACAC ATAAATATTC AATTTTGTAT TTCAACCCCT
349751 AAATTTCCTA AGTCCATGTT TAATATACCT TCTGTCGAGA GAGAGAGACA
349801 GAGACAGAGA CACAGACAGA GAGTGATTAT AATATATTGA TTGGCTCATG
349851 TAATTACGGA GGCTGAGAAA TGTAAAATCT GCAGTCAGCA AGCTGGAGAC
349901 CCAGGACAGC CTATAGTGTA AATTCCAGTG TGAAAGCCAG AAGGCTCAAG
349951 ACCCGAGAGG AGCTGATATT TCAGTCTGAG CCCAAAGATG AGAAAAGACC
350001 AGTGTCCCAG CTCAATCAGT AAGGCAGGAG GAGTTCCTTC TTACTCAGAC
350051 TTTTTGTTGG TTCAGATCTT CAATTGATTA GATCACCGCA CCTACATTAG
350101 GGAGGGGTAT CTTTACTCAG TCTACTGATT CAAATGTTTA TCTCATCGAG
350151 AAACACGTTC ACAAACACAC CCAGATTAAT ATTTGGTCAA ATGTCTAGGT

FIGURE 3YYYY

350201 ATTCCATGGC TCAGTCAAGT TGACACAAAA AATTAATCAT CACAAATCTA
350251 CCCCTTGTCA ACTTGGCATC CATATGCATC TCCCTAAACC ATACTTCTCC
350301 AAAAAAAGAC AATAACAAGG TCATGTTTCC TCCTAACATG TTACAGTTAT
350351 CCTGTGTACA ACCAAAAACA CACTAATATG TTAGAAGTGG AGATAAAGTC
350401 CTGGAATGAT GTTAACTCTT CTCCTTGATG TCATGTAACT TACACAATAT
350451 AAGGTAAAGT TAACACATCT TACTTTACAT GATAAGGGAG TAGGGGAGGG
350501 AAGAAAATGA AAATATTTGC TTTATCCATC TGTCTGTAAA CACACACACA
350551 CAGACACACA CACAAATTTA TTACAAAATA AGGTGAAAAC ACTCATGACA
350601 ACTAGTCCTC ATTTTCTCTG TAACTGGCCA CGTGGCCATA GCTGGTATTT
350651 ACAACTACCT TCTTCTACTA CCTATTCTGT ACTCCCTTTG TCTTTAGCAG
350701 GCACCTCAAG TGGTCATGGT TCTTTACAAG TGTCAGTCGA GAAAAATGAT
350751 GAGACAAGTC TTAATCATTT TAGGAGACTT ATTTGCCAAA GTTAAGGATG
350801 GGCACCAGGG AGACAGGTCT ATGCCTTTTT TCTGGAGATG ATTTTGAAGG
350851 CTCCAAATTT AAACGGGAAA GGGTGGGATA TTGAGAAGTA CACAATTTTC
350901 ATGTAAGAAG GGGGTAGGGA AAAATAGTCA TTTATGTCTT TGTCTGGCTC
350951 AGTGAATCTG CATTTTTTAC ATAAGATGAC ATAAACCAAT GGAGTAGAGG
351001 AAAATGCAGG GAATCTGCAT TTTACATAAG ATAACACAGA CAAATTGGAC
351051 CAGGGGAACA ATCAGATATG CATTTGTGTA TGGTGGGCTG GAGGTGACTG
351101 CACCTCTAAA GATAAGCTAT CAGTTTGCAT TGCCATGGTG AAATTTTAAC
351151 AGCTCACTAG GAATTTCTTT GTGGGCAAAA TATGGGGGAG GCGTGTAGCT
351201 TTTTATGTTG TAGCCATCTT ATTTAGGAAT TAAAAGGGGG AGGCAGGTTT
351251 GTGTGACCCA GTTCCCAGCT TGACTTTTCC CTTTGGCTAA ATGAGTTTGG
351301 GGTCCCAAAA TTTAGTTTCC TTTCACACAT GGTAGGATGA TACACACCTT
351351 CATTCATGAA CTGCCTGGAC CATTATTAGC CCTGCCTGGA TTAGGTTAAT
351401 GTTGTTTTCT AATGACCTTA ATCACAGGGC ATGGTAATAC TAAGAGACAC
351451 CCTAAAGAAT CTCCTGTATT CTAGATATAC ATTTCCTTAC CTTCATTGTG
351501 GAGTCGTGTT TCAGTTTCCT CTTGGTAGTC AGGATCAATC CCTCCAGCCA
351551 GCACAGTAAC TCACTTATTT TTTGAGCCAG AGGCATGAGA AGCACAAAGT
351601 GGCCAGGTGG TAGTCTTAAC TTCCAGTTCA ATGGAATCAT CATTACGTAT
351651 GTTGGTGGAA GTATTCCTGT ACTTTGGAAT TAAGACCGCT AGGCCAGAAG
351701 AACATAAGGT TGCAGGAACC AGAAACAAAT ATTTTCCTGC TGGGTCACTG
351751 GGAAAATAGT GAGTGGTGCT ACTTCTATTT TCATCCCTTT ATTCCTAGGC
351801 CTGTGAATTA TGGCTGCTGG AGAAGCCATA CCTTATATTG GATGCTGATT
351851 CAGAATATAT ACAGCCTCTG GAAAACCTTC CCCAACCCTG TAAGATATTG
351901 CTACCTTACT GGCACTGTAA CTGGGTCTTC AATATGCCCT GCCACTATTC
351951 TGTCAAGCCA GCTGCCTCTG GATAATGGGG AACATGTTAA GACCAGTGAA
352001 TTTCCTGAGC ATAGACCCAT TGCCATACCT CCTTTGCTGA GTGAGTTTTT
352051 GGTCAGAAGC AATGCTGTGT AGAACACTAT GATGGTGGAT GAGGCATTCT
352101 GTAAATCCAC AGAAGTTTTG GCAGAAGTAT TGCATGTAAG GAATGCAAAT
352151 ATGTATCTAC GGTGTGTTAT TCCTGTGAGA ACAAAATTCT TCCTCTTCTA
352201 TGATAGAAGT GATTCAATGT AATCAACCTG ACACCAGGTA ACTAGCTGAT
352251 CACCCTGAGG AATGGTGCCA TATTGGGGAC TCCAGTGTTT GTCTCAACTG
352301 CTGGAATATT GGGAACTCAA AGGTGACGAT AGCCAAGTAT GCTTTGGTGA
352351 ATAGAAGTCC ATGTTGCTGA ATCCATGTAT AACCTCCATC CTGCCATCGT
352401 GGTCGCTTTG TTCTTGAGCT CATTGGGTAA TGACAAGGTG GCCGGGAAAA
352451 AAGTCTGACT GGTATCTACA GAACAGGTCA TCCTATCCAC TGGATTATTA
352501 AAATCCTCCT CTGTGAAGGT CATTCTTTGG TGTGCATTCA CCTAGGACAC
352551 AAATATCTTC ACTTTTTTTT CTGTTTTTAG ATGGAATCTC GCTCTGTCAC
352601 CCAGTGCAGT GCAGCAGAGT GATCTCGGGT CACTACAATC TCCGCCTCCC
352651 GGGTTTAAGC GATTCTCCTG CCTCAGCCTC CCGAGTAGCT GGGATTACAG
352701 GTGCCCCCCA CCATGCCTGG CTAATTTTTT TTTTATTTTT AGTAGAGACA
352751 GGGTTTCATC ATGTTGGCCA GGCTGGTTTC GAACTCCTGA CCTCAAGTGA
352801 TCTGCCTGTC TCAGCCTCCC AAAGTGCTAG GATTACAGGC ATGAGCCCCC
352851 ACATCCGGCC TATCTTTACA TATTTTTACC CATTCAGAGA GGTCTATCCA
352901 CATGCATCTT CCTTAGATTT CCCTGTCACC AATTTCCCTG TTATCTTCCT
352951 TCCAAGTTCC TAATCATCTA GCCATCATTG GCTGTAGCCC ATGCATTGTG
353001 CTACAGAATT GCAAGTCTGG TCATTTCTCC TTTCCAGCAA AGTGAATAAT
353051 CAGGTTCACT GCCCAGAGTT CTGCTCACTG AGAGGATTCC CCTTCACCAG
353101 TGTTTCAGGG CTGTTTCAGA AAGGAGCCCT AGTTCTGTAG CTGTCTACTT
353151 TTGAGTGGTG CCTGCATACA GGACCATCTA TAAATCAGGT ACCAGGCTTT
353201 TCTTTTGTTT CAACCAAATG TAGGGACTCC CTGCCCATGA GGCCATAGGT
353251 GCAGACAGGA GACAGAAGGC CATGGAGCAG GAGTGGGGAT CATGGGTATT
353301 TGAGCCGTTT CTTTATGGAA CTTACTTTGC ATTCAGGGCC TGCTTGGGCT
353351 GGATAACGTA TTTACTACTT CCATTTGATG ATGGAGTGTT GTTTGCATGC
353401 CCAACTTTAT GGCTTCATAG GTTAGTTAAC ACCAAGTTTA TTATGAGCAT
353451 CTCAAATTGC ATGGTAAGTT GGTGGCCTGT GTTTAAGTGT TCGGTCTCTA
353501 CTAAGTCCCA ACATTAGGCC AAAAGCTGTT TCTCAAAGGG GACTAATTAT
353551 TTTTAGATGA TGCAATGGTT TTGCTCTAAA ATCCAAAGGG CCTGTACTAC

FIGURE 3ZZZZ

353601 AGACCTGTAG GGACCTGTTC TACCCTTCAC CTGTAGGAAC TTGCCAAAGG
353651 CTCTAAACAG CTTCCACTAC CACTACCGCT GACACTTTAA GCACCATTGG
353701 ATCTGCTTAA TTGTATGGCT CATAGTGGAA GAGCAGCTTG CACAGCAATC
353751 TGGATCTGTT GTAGAGTCTT CTCTTATTCT TGGCTCCACT CAAAATTAGT
353801 GTTTTTCTGG TCACTTGGTA AATGGGTGAG AGTAACACAA ATGAGGAGTA
353851 TGTTGTCTTC AAAATCCAAA GAAGCCCACA AGGCGCTGTG CCTTTTTTTC
353901 TTTTTCCTGG CGGCAGGAGA GGTCAGATGC AACAACTTAC CCTTCACCTT
353951 AGAAGGGATA TCTTGATATG CTCTAAACCA CTGGCAGAAA AAAAAAGGCC
354001 CCTGAATTTT TGTCATATTT ATTTATCACT CTGACACAGA AATGTCTTAC
354051 CAATAAGTCT AAAGTGGTTG CTACTTCTTG CTCACTAGGT CCAATCAGCA
354101 TAGTGTCATC AATGTAATGG ACCAATGTTG TATGTTGTGG AAAGGAATTA
354151 AATCCTTGTG AACTAAATTA TTACATGAGG CTGGAGAGAT GATGTATCTC
354201 TGCAGTAGGA CAGTGAAGGT ATATTGCTAG CTTTGCCAGC TGAAAGCACA
354251 TTGCTTCTGG TGGCCCTTAT TGATAGGGAT TTAGACAAAG GCATTTGACA
354301 AATCAATAGC TGCATATCAG GTACAAGATG AAACCACATC TGCAGCAGCT
354351 GCAATTGGAG TCACTACCTG AATAAGCATA TGATAATCTA CTGTCATTCT
354401 CTAGGATCTG TCTCTCTCCT GCACAGGTCA AATAGTCAAG TTGGTTGCAG
354451 ATGTGGTTGG AATCACCATT CCTCCATCTT TCAAGTTCTC AATGATGGCA
354501 CTGACTGCTG CAGTCCCTCT GGGAATGTAG TATTGCTTCT GGTTTACAAT
354551 TTTCCTAGGT AGAGACAATT CTAGTACCTT CCATTTGCCC TTTCCCAATG
354601 TAATAGATCT CACTCAACAG ATAAGGGAAC TACTGGGATT CTGCCACCAG
354651 CTGAGTATAT CTGTTGCAAT TATGTATTCC TGAACTGGGG AAATAACCAA
354701 AGGATGGGAT CAGGGATCCA GTGGACCAAC TATGGGACAA AACTGAGCAA
354751 GAACTCTATT TGCTGATATC CATAAGCCCC TACTCTAACT GGTAGACCAT
354801 AGCCATGTGG TCTCCTGGAA TTAGTATCAA TTCAAAGCCA GTATCCAGTA
354851 GTCCCTGGAA GATCGGATTA TTCATTTTTC CCAATGCACT CTTACCCTGG
354901 TAAAAAGATA GAGATGCCTT TCAGGAAGGG TGAGAGAAAG ATTAACAGTG
354951 TAAATTTTTG GCAGCGTTTT GAGGTCCTTC CTCAAGGGTA CCCAGCCTCC
355001 CCTCATTTAA GGTGTTCTGG GTCTATTTAC TGGCTCAAGT CTGGGAATTG
355051 ATTGAGAGAG CATGACTCTC TGTTTATATG ATTCAGGCTT GACTTCTGTT
355101 CACTTGACTT GGAACTTAGT GTTAGATATC TATTTTACTT TTAGAAACAC
355151 TATCAACTAG CCAATGTCAT AGTCCTTCTC GACTCAGATT ATCTTGATGG
355201 CTGCTTCAGT TCTGCTGTGC ATTATCATAA CCCTTCCCAC TTTGCCTTTG
355251 GTGGTTGAGT GCTGTGTATC AGCCCCTGCT GCCCTGGAAC TGATTACTTC
355301 CATTGCATTC AGGTTTCCTA ATTCAGTAGC CACAGTTTCC ACTGTAAGGT
355351 CTGGCTTACA GATAAGTGAA ATCACTCCCC TCACATATTT ACTTTTCAAA
355401 TTATTTATGA AAGGTATGTC TTCTGGACTC TCCCATTGTG GGTTCTACTG
355451 AAATGACATT AAGACTTAAA TGACAAATTC ACTCTAATAT TCCAATTCCT
355501 CTAAGTTTTT AAATCATCTT CTGTCCATTA AACCAAGGCA GGTCTGGCAT
355551 TTCCAACTCA CTCATGATGG GTCATCTTTT GATCCATATT TCAACCAACT
355601 AAGCAAACAA ACCATTAGCA AACAAACCTT TTCCAGCTCC CCAAACGACA
355651 AAATTTATTG CAAAATCTCT GCTTATTGAG CTCATATCAA CATATTCAGC
355701 TTGACTTAAC TTTATATTCA AAATTATATT ATACTCTTAC TATTCATTCC
355751 CACACATGTT TCCAGGATTT CTGTCTTTAT ACATTTAGAA AACTCAGTAG
355801 GTCTTTTGGA ATATAGGACA CCTCCTTAGG AGTCACAATT TGTACCTTGT
355851 CTAGTTATAG GTCTAGAAGT AAAGAGGGAT AGTGGTGATG GGTCCTGAGG
355901 AGGCTCAGCA TAAACTTGCA AGGCAGCTAT CCCATAGGAG ACCATTACAG
355951 TCTCCACAGG CAGTGTAAGG CTAATTCCCT GAGATGGGGA TGGAGAGGCA
356001 GCTTTCATGC CAGGGAGGCA TCTGCCACTG GCAAAGAAGA CTCATCAGAA
356051 TTTAAGAACT CAGTGACCTT GGCTGCATCA GGCCATTCCC ACATGGCCCC
356101 AATTTACAGA ATTCTATTTC TTCCCAGTCA GTGCCCTCAC TGTAACAGTA
356151 GACACCCTGA AAAAGCTGGG AGTATACTTG TATTATCATT AAGCCTGTTG
356201 AAGGAAGATA TTCTGCATTT GATTTTTAAC AATTTCAATT CTGCAGCTAC
356251 TGGAAATAAA AGTCTTCTTG TGGGTACACA CAGATGCCTT CAGGTTATTT
356301 TTGTGGTGCA TAAACCAGGA ATTCCAATTC TTGAGCTTTT CTTTCTCCAC
356351 TTCTTCCAGT GACAATAGGA GGTAACTAGC CAATCTCATT ATATTTGTTC
356401 ATATATATTT GACATACATG TCCAAAAATA TCCTATACAC TTTCACTCAG
356451 ATCCTTGCTT CTTATAAGTA GTGGAATAGG AGTATCACAT ATAGATATTT
356501 TGCATATTTG TATTGCCAGA TTGTGCTAGG GACTATCTAT CACTGCTCTC
356551 TTTGCTGTTG GAATAGTGTT ATTAGCATCT TTAAATCTAA TCCTATCATA
356601 TTATTTGCCT CCACGTAACC ACAGATGGCT AATTTGGTCA TATATTCAGG
356651 CATTAGTAAA TGGTTAAAAT AATAGTATCT CTTACATATC TCATTTTATT
356701 TCTTACGTGT TTTATGTAGA CTGTTCAATT TCTGAAAGTT TAAACCTCTC
356751 ATGTTGCTTA TTTTTCTCTC CTCTGCTACT TTTTAGTGTT ATTATGTCCT
356801 TTAAAATTGC AAAAATAAGT AGAGGCTTGG TTTAAATATT ATTTAAAATT
356851 GTGAATTGGA AATACTGAGT ACTTCAGTAT TACTCAGATA TAACTGAGTA
356901 ATTCAATTAT ATCTTCAAAT AACTGGTGTT ATTTGAAGCT ATATTATATT
356951 CACATGGCAT ATGTGGTTCC CAGTGGGCAA ATGATATTTT GGGAGACAGT

FIGURE 3AAAAA

357001 CTTTTTTTCA TGATTAAGTC TTACTTTACT TTTTCTCTCT TCGCAACCAA
357051 TTAATTGTCA GCTTTTATTG GCTCTGCTTT CATGATGTCA CTTACTTATC
357101 TTTATTTCTA CCACCAGCAT CCTATTTGAG GGTCTTATTA ACTCTTTCTG
357151 GAACTTTTAT TTAATGGACT CTTTCTCTTT AATCATTTCT GCCACTGATC
357201 CATTCTGAGG CCAATTTAAT ACTGTAAGAA CAGAATTCTT ATCAATAATC
357251 TTTATTTCTC ACCACTGCCA ACTAAGTTGA ATATGAAATA CACAGCTTAA
357301 TATGTAAGAC CCTCCACATC AGGGCCTCAT GCTACCATTT CAAACATTTT
357351 TGTTACTAGT CTTCTACATA TAGAGGTAGA GAAAAACTGG TCACTTTATT
357401 GTGAGTTAAA ATGTGTTTCT GTTTTTGCAT TTGCATTCCT TTGCTTGTGC
357451 TGTCATCCCT GACTGGACTT CTTTACTCCT TTGCTGTAAT CTTTTCCTTG
357501 GAGATACCAC CTATACTCCA AGATTACCTC AAATGTCTTC TCACTCTCCA
357551 ACAAAATGCA ACCTTTCTAT TCTCTTAAAT TCCACTTCAG GGACTTGTAA
357601 CATATATAAT ATTTTCAACA TCAGATTATA TATATTTTTC ATAAATTATT
357651 ATAAACAGTA TACCTTCTGC AAAGTATAAT GACTTACACT TGCAAAGTAT
357701 ATAATAAGCA TTTTTAAAAT TTACTTAATT GATATCACTA TTTGGTGAGC
357751 TGCAGGTGGC ATTAAGATCA TGGGGCAGTG GAAATCAGAG CAAATATATC
357801 TACAGTGTCT GGTTCTAAGA GTGAAAAATG TCTGAGCCTG GTAAAGAGCA
357851 GAAAAGAGTC AGGGTATAAT GAGCAGAGAC AAGTCTGGAC TAAAGTGGGA
357901 CAGACTAGAA GTGATTGTTA TAGCCTAGGA TCATTATCAC TCTGACTCTA
357951 CTGGTTAAGT TTTCTGCAGA AGGAAATAAA GATTTTGCTA GCGTGAGTGA
358001 GCACCACTGT GTAGGAAAAA TTATCTAGAA AGTAGAAGAG GTAAGGAGCT
358051 TCTCCATATG GGAAGTAGAA GTAAATAAAT TCTTATTGGA AGTTGAAATG
358101 GTATTATATT TTGGTAATTA ATGATTTCTT TGAAAGTCTA GTGTTAAGTA
358151 TTCAATAAAA AATTGCATTG TGTCTTGTCC CTACAAATCA AGTTTGCAAT
358201 GCAGTCTGAC AAATACAGAT GCTTTTGGTT TCAATTTTGA AAAGAAGTGC
358251 ATGACTAGAT TTCTGTGTAC CTATGAAGAT GTGATAAATT ATTTCATATT
358301 TTCATATGTC ATTTGGAATA GGCTTAGAAT ATCTAATGGA CCACTATGTT
358351 TTTTAATATT GAATTTGGGT GATTGTTTTA TTGTAGAAGC AATTACTCTC
358401 CCAAAGGAAG TTTTAATTTA ATGGAGCAAA CATTCGGTAA TCTTGTTATT
358451 ATGTGCAAAT ATGTAAGTGC TGCTATGAAG GACACTAGAT ATTGTTCTCA
358501 GTTCCAAATA CTTACACACT TTAAACAATT AGTTTGATAT TAAAATACCT
358551 TTATAGTTTT TAAAAAGACC TTACAATAAT TAACAAAACA TTTATGCTTT
358601 CATCCTTTGT AGTCAGGAAA GAAAAGCTGA AAGTATGTAC TTGTTTTTAA
358651 AAAAAAAAAA AAATAACAAA CGTGTGTATA ATGGCTTCTA TGATGTTGGG
358701 GGGTGGGGAG ACCCTGCCTG TGATCTTATG TATCACGAGT AGGTGATTTA
358751 TTAAGTTAGG TTGGAAAGTC AAATTAAAAT AGAAATTAAA ACAGTTTTCT
358801 CTCATGGTTG ACAAAAATCC ATATTTATTC ATATTTGGCA GATATTTTAG
358851 CGTTTTTGAA GAATCTTTGG AAGAATGTTA AATACAGTGC CTGGGCTACC
358901 ATACACAGTT GTTTAGTTTG TGGACTGCAT AACTCCAAAG GCCCCACATT
358951 CCTCAGGATG GGCCAGATAA TTCTGCAGTG ACAAATGCAC CCTAAATCAG
359001 GGCAGATTAT CATAACAATG TTTTGTTTCT TTCTCATGCT GTATAAGTAC
359051 TGCTGATCAG CTACTGCTCT GCTACATGTC ACCTTCATGC CATACTTCTA
359101 GGCTAAAGAA GTGTCTCCTA TTATCAATTT CTGTTCAGGG AAACAGGGAA
359151 AGGGAAACAG TGAAACATAA TCAGACTCCT AAAGCTTTTA ACCAGAAATA
359201 ATACAGGAAC TTCAGCTTAT ATTTCATTGG ACAAAGGAAT TCAAATGACC
359251 ACAATTCACC AAGGCATGGA CATATAATCT TCCTACAAGA TACACCGTGG
359301 AATATTGGCA GACATTAATG TGATCTACCA GAGGCACCAT TCATATTCAA
359351 TAAGACACAA ATGACATCAT TCATGTATGC AAAATGCTGT TGTGCCAGGA
359401 AGCATCTTTT CTGTTTATTT ATATTAAAGC AATACAGTAT ATTATCTGTT
359451 TGAATTAAAA AGAAAGAAAA ATTCAGACAG ATGGAAAATA TGGGTTTGAT
359501 AAGAAATCAA AAGCATGTAT TCCCTTCTTT AATACTTCTG AGGATCATTT
359551 ATCTTTTCAT CTACCACCAA CCTAAAAGTA AATCACAAAG GGAAACAGAT
359601 GCCTCAGACG GTGCCCAGCT TTCCTCTATC TCAGAAATTC TACATAGTCC
359651 CAGCTTCCTC TTAATGAAGT CTCAATGATT TCTGTTTCAA CTTAGACCCT
359701 GAATTTCTAT GTTTTCAGCC TCCATAAATA TTTATTTTAG GTTTTTTTAC
359751 TCTACTGTAT GTTTAGGTGT GGATATTCAT GTTAACTTTT ATTTTAAAAT
359801 AATCCCAATC TAAGTTAATT AGAGAATTGA CTTAGACATG TCATTAATTT
359851 TGAAGTTCAA AACCCTGAGT ATTAATAACA AAGCTAACTA GCTGATAACT
359901 CTCTGTGCTT TAAGATATAA GGTGTCATAA AAGATTATGT AGGTTCTTTT
359951 TAATACTATC AAACTCTAAA GAATAGTGTT CATTAAGACA CTTTGCATGA
360001 GGAACAGCCT AATTTATCCA AGTCATATTT TTATATAGCG TATTTAAAAT
360051 AAACAGTATT CTTTAGTATT AATTATAATG GATAATAGGT TTTCAAAACT
360101 AATATTTGGA ATCCAAATAT TCTTAAAATA AATAGATGGC TCACCATTTT
360151 TATTATTAGT ACCATAGCAT CCATTTTAAT ACTCTGAAGT TTTAATTATT
360201 TCAGTATTAC ACAAATTAAG ATTTTAGACT TTACCTTTCT CTTTGATTCC
360251 ATAACTAATA AAGATTTAAA CTATTAAAGA TTTCAATATA ATTTCATTTT
360301 GTATGTATTT AGTAAAGAGA ATTCACTTAA GAAATTTTTC TTAAGAAAGT
360351 AAAGATTATT AATTTCATCC TTTTCACATG ATGGCATGAA TTTTAAAATA

FIGURE 3BBBBB

360401 ATTCTGTTTA TAGTTTTGCT GACATAATGG AAAATATCAA TTGTTATAAA
360451 GTTATTATAA AATAATTAAT TTTTTTACTG TGACTGAAAA TGTTATTTGT
360501 AAATTCTGAC ACCTGCTTTT TCATTCTCAA CAACGATTCT AACTCTACAG
360551 TTATTTATTC TATAACACTT TGATATGGTT TGGCTCTGTG TTCCCACCCA
360601 AATCTCATGT TGAATTGTAA TTCCCAATTT TGGAGGTGGG GCCTGGTGGG
360651 AGGTGATTAG ATCGTGGGGG TGGTTTCTAG TGCTGGAGGA CCATCCCCCT
360701 AGTGCTGTCT CATGATAGAG TTCTCAGGAG ATCTGGTTGT TCAAAATTGT
360751 GTAGCACCTT CCCCTTGCAC GTGTCCATGT TCTCTTTTTC TCTCTCTGTG
360801 TTTCTCTGTG TGTTTCTCTC TCTCTCTTTC TTTCTTTTTC TCTCTCTTTC
360851 TCTCTGTCTC TCTCTCTCTC TCTCTGTGTG TCTCTCTCTG TCTCTGTCTC
360901 TCTCTTTCTC TCTCCTGCCG GCCATGTGAA GATGTGCTTG CTTCTCCTTT
360951 GCCTTCTACT ATGATTGTAA GTTTCCTGAG GCCTCCCCAG AAACAGAAGC
361001 CTGTACAGCC CCAAAGAATG GTCAGCTCAT TAAGACCCTT TTCGTTATAC
361051 CCAGTTTCAG GTAGTTCTCT ATAGCAGTGG GAGAATGGGC TGATATGGAA
361101 AATTGGTACC AGGAGTGGGT TATTGCTATA AAGATACCTG AAAATATGGA
361151 AGCAACTTCG GAAGTAAGTA ATGGGCAGGG GTTGGAACAG CTTGGAGGGA
361201 TCAGAAAAGA CAGGAAGATG AGGAAAAGTT TGGAACTAGA GAGTTATTTA
361251 TAGCAGTGTG ATAATGGACT AATATACACT CTTTTTTCTA GTACTTGTAG
361301 AGTGGCATCT TACATTGGTG TAGGATTATT ATACTTCGCA ACACTTGTGT
361351 GTCACATTGG AGACTGTCTT ATGCTCTCAG AATGTTCAAT GTAGTCAATT
361401 TTTCCTTCAG CGTTGAAAGA GGTTGTTGTT TCTTCATTTG AGATCCAGGT
361451 GAAGTTGTTT GCCTGTGTTT AATGGCCATT AAACCACTAG TTTAGTGTTT
361501 AGTTGGATTA AATGCACACA TTTTTAAGCA ATCAAATCAC ATTCAATGTA
361551 GCATCACATG TGCTGAGGCT AGATGTGTGA AGGGCATGGT AGTTTAGCTA
361601 AGACACAAGA TACAATAGCA GGTTCTCCAC TTTGATTTCC TGTTCAATCT
361651 GGAATACACA TTCATTCAGT GCAATGGATA GTAGAATTAC CTTCAATGCC
361701 TAATTATTTA GGCATTCTTT TTGCTCTCTT CTTATCCTTC TCCCTTCCTG
361751 ATAATCTTCC TCTCCCTATC TAGTTAAACT ATTATTAGTA TCTTGTATGT
361801 ATGATGTGGT TCCATTGTAA ACTTCTTTAG AGGCTTATTA AAGCCTCTCT
361851 TCTACAGGCT CATTTTCTGA TATGTCTTCC CATTTCATTT GCAGATGAAA
361901 AGAATTATTG TCAAACTAAT ATAAATTCAT AGATACATAT TTGCACAGTA
361951 GTGCTTCGTA AAATGCAGCC ATTTATGTAT TGATTCTTGT CTTATTTTTC
362001 CTTTTTCTCA TTTTACCTCA CCTTAGTTTT TTCATTTGAA TAAATGAATT
362051 GCTTTTCCCA CTACTAAAAG TAAAATTTGT AAAGATTTTA ACTTTATATG
362101 TTTTTACTTT AAGTAGATTT CATATGCAAT GCAAAATTTG GATGTGAACA
362151 AGGAGGCTAT AAAAAAGCCA GAGTAATAAG TGGGAGTTGA ACAATGAGCA
362201 TGCATGGACA CACGGAGGGG AACATCACAC AGTGGTGCTT GTCAGGGGGT
362251 TTGGGAAAAG GGAGGGAGCA CATTAGGACA AATACCTAAT GCATGTGGGG
362301 CTTACAACCT AGATGACGGA TTGATAGATG CAGCAAACCA CCATGGCACA
362351 TGTATGCCTA TGTAACAAAC CTGCACATTT AGCACATGTA TCCCAGAACT
362401 TAAAGAAAAA AAAAAAGCCA AAATAGAAGG AAACAATCAC TGCTCTAAGA
362451 ATAAGTGAAG GAGTTCTATA TGGAAGGGAA TTGAGGAGGG GAACTTAAAT
362501 TTTAGGTTTT ATGGTTGAAG GCAATGAGCA AGTTAAAATT GTTACTATTA
362551 GTGCAACTTT ATTTGTACAC AAAATTGAAT CAAGAAATCC ATGTTTTATG
362601 ACTGAAAGAC CACTGCTATG AAGCTGCTTT TAATACCTGG GGCGTAATCT
362651 GCAGGAATGA GCCATGATGA ATGTGAAAGA CTGGATAAAG TTGGCAAGTT
362701 TAAGGCTTGT GCTGAAAAGA GATTAAGAAA TATGGAGCCA GGCGTGGTGG
362751 CTCACATCTG TAATCCCAGC ACTTTGGGAG GCCGAGGTGG ACAGACCACC
362801 TGAGGTCAGG AGCTCGAGAC CAGCATGGCT ACTGTGGCAA AACCTCATCT
362851 CTACTAAAAA TATAAAAATT ACCCAGGTGT CATGGTGCAT GTCTCTAGTC
362901 CCAGCTACTC AGGAGGCTGA GGCAGGAGAA TTGCCTGAGC CCAGGAGGCT
362951 GAGATTGCAG TGAGCTGAGA TCTTACCGCT GCCCTTCCAC CTGGGCGACA
363001 GAGCGAGCCG ATGTCTCAAA AAAGAAAAAG AAAAGAAAAA AAAAGAAATA
363051 TAGGACCAGG TCTGAGAGGA GACAGAGAAA TAAATTCCAA GGAGTTATAC
363101 ATATGCACTC TTCATATTGA TACACTTTTT CTTTTTTGAG AATACAGGTG
363151 TTCCTCAAGT TAAAATGGGG TTGCATCCTG GTAAACCTAT TGTATGTTGA
363201 GGATATTGTA AGCCAAAAGT GTATTTTTGC ATATTGAATG TGTATCACTA
363251 TGAAGTCAAA ACATGTATCA CCATAAATTC AAAAAATGTA ACTTGAACCA
363301 CTATAAATAA TGGACTGAAA AGGAGTGAGA AACTCACCAT TAAGTGTAGG
363351 AACTAACCAG GAAAAAATTG TCTTAGAGAA AACGAGACAA TTAGAACAAA
363401 GATGGTTAGT ATCAGCTACA GATTTATGAG AGATGGACGG CATTGATTTC
363451 CCATGGAGTT GAGACAAACC ATGTTAAATC AGTGTTTTTC AAATGTTTAA
363501 GTGAATGAAT GAATGAAAAA CATTAAGTAT AAACATTTAT TCCAAATGCA
363551 TAGAAAGGAA TTAACTACTA TCTAATGAAT GAAAAGTGTG AGAAGAAGAT
363601 AAAGCTTAAA CTTTTTTGAA TCATGGAATA AGAAAATAGG AAAATTTATG
363651 TGTAGGAGAG TAATAATATC ATTTGGTAGA ATCTAGGGGG GAGGAAGAGG
363701 GACAGGAATT GAATCACCTA TATTTATAGG AAGCAAGAAA TAATGAACAT
363751 AGAATTAATA GGAATGGAGA AGAAGACAAA CATGCAACAG GTATTATAAA

FIGURE 3CCCCC

363801 GATAGAACCA ATATGTTCAA AGATAGAACC ATCTTAGAAG TGACATGATT
363851 TCTGGGTAAG TTTGGAACCA CAGCTAGCCC CAAAATTCAC CTGTAAGTTA
363901 TTGGGAGAAT GATAGTACAA TTACCAGAAT TATAGCAAAC TAGAGGATGA
363951 ACAGATTTAG GATGCAGTTA GTGGGGAGGA AGAAAATGAT TAGTTCAATT
364001 AGAGACATAA TAAGCTTAAA TACCTGTCAA TTATGATTCC CAGAAGATAA
364051 TTTGAAAAAA AGCCTATGTC ATTTGTCAAA GGCAGAAAAC AGGAATCACC
364101 AAGAGCCAAT CCGGAGTAGA ATGAGTTTAG GGATAACAAA AAACCTTGGT
364151 AAACTATAGG TTAAAATTAT GGAGTAATTA CTGAAGAAGA ACAATAAGGC
364201 TATACTATCA AGTAAATCAA AGCAGCAATA TCAAGAAGGA AGTGCCTTCA
364251 ACTTTGCTCA ATTCAATACT GAGGTAGAGT ATTGAGAAAG GCAATTGGTA
364301 TCTGATTTAC TGGTCACCTT TAAGAATATG GTTTTAATGA AATGATGAGG
364351 GGAAGCCAGG TTGTAATGGG CCAAAAAAGT GGTGGGTGCT GTCTTGAACA
364401 TGGCATATAT AGACTGATGT TTTGAAAGTT TACAGTGAGG CATTGGTTTA
364451 AAAGAGTGTA TAGTGACCTA AATGGGATTA GGATCAAGAG ATGTGAAATA
364501 TGTAGAAATA ATAACTATTA TATCTTACCT ATTTTCTGTC TCCTCTGGAT
364551 ATGTAACTAT TTTATATCTT ATGTTGAGTT TTGCACAGTT TCTGACATAC
364601 AAAGAAGTTT CTTAACATAT TTGTTGAATT AATGCAGAAA TGAGTGAGAA
364651 GGCCAGCTGG GAAGCTATTT ACTTTTCTAT CCAGAATGCT AAAACTCTCA
364701 TCCCTTGCAA CTATTTCAGG AATAGATAGT TCAAGCAAAA CTATCTAATT
364751 GCACTGTGAT TCTTACTCAT TCTAAAATCT GTTATTGGTA CTTGTACATA
364801 GAGGAAATAT GAAATGCTGA AACACAACTT TAAGCAAATG AAAACTAGTC
364851 ATACAGTTAG ACACAATGCC AAATAGTTTT TTTGGGGGGG ACTGAATTAG
364901 ATTCCTTTTT AAGTGTCGCT TCTGGCCCAT GAATATGTAT CTGTAGGTTT
364951 GTGTACATCT GCTTTGATCA TAACATTCCA AAAGTGTCAT ATCCTAAAGA
365001 AAAAGAATTG CTCTAAAACT TAGAGATGTA CTTACTGTTG TATTCTATCA
365051 GTATCTCAAC TGGCTTGCTT TGAATAATAG CATCATCAAT TTACTTTTCT
365101 GTTGCTCAAA TGACCGGTTA CAAAGCACAA CCAAACTGTT GTAGTTTTAG
365151 GAAATCAACA GTATTTACAT TTTTATTGAG CAAACAGAAT GCTATTCATT
365201 GCTTTGACCA GGGGTTACTG ATGATCTGAA AAGTGATTAA TGGTCAGCAA
365251 CAACAAATTT ATTTCAGGAG CTTATAGATT TCCATGGGAT GTGATTTTAT
365301 GCTTTAGTTG ACTTGCCATG TTTTGTCATT TTTTTATTAC CTCCCATGCC
365351 ATATACTGTG TAAATATATT AAACTTTTTG AGATATCTTA GATGTTTTGA
365401 CTGGATCTCG GCTTACACTT GGACAAGTTA GATAACCTAC CAACAGTAAT
365451 AAATGTAAAT GTGAAATGTC ATAAAGTGCT TTTGAAATGT ATTAAAGCTT
365501 AAATGTCAAG TGGCATGCTA GCATATTTTA GAAATATGAT TTACATTAAA
365551 TGTTTTAAAA TATTATTTTA AGACATTTAA ACAAATACGA GCTAAAGAAC
365601 TAGTGGAAAT GTCTGTTCAT ACAAAACATT TCCCAATGCC AGACCAATGT
365651 GGAAAAAATA TTTAAAATTT TATGAAGTAT ATATGTATTA AGTACATCAT
365701 GGTCAGTAAA TAAAGAGACC ACTGGACTTG TAACCAGATC ATTTAGATTC
365751 TAGTCCTAAA ATATGCCAGG ATAGCAGCAG AGTGGGAACA TTTTTTGAAA
365801 ACTATACTAA TTACTATGTG TCAGGAAACA GAACATTAAC TACACTCTTA
365851 ATTCTACAAG TATTTTCAAC AAGTTTCCTG TTGTACTTAC CTTTATGAAA
365901 TAATCAGTCT GCTTCTCTTT TAGGTAAGTG GAATCTGTAA TGTATACAAG
365951 ATGTGAAAAT AAAAGTACTT TGATTTAATG TATAGATTTA TAATTATTAA
366001 CTATCCTGCC AAAGTAACAA ATGACACATT TAAGTGCAAA CATGTAAGAG
366051 GTGTATATAG TTATAAAGTA CATGAGATGT TTTGACACAG GGATGCAGTG
366101 TAAAATAAGC CCATCATGGA GAATGGGGTA TCCATTTACT CAAGCATTTA
366151 TCCTTTGAGT TACAAACATT CCAGTTACAT TATTTATTTT AAAATATTCA
366201 ATTAAGTTGT TATTAACTAC AGTCACCCTA TTGTACTTTC AAACATTATG
366251 TCTTATTCAT TCTTTCTATT TTTTTTACCC ATTAACCATC ACCTTCTACC
366301 TTCCCCCCCA GTCCCCCACT ACCCTTCCCA GCCTCTGATA ACTATCTTTC
366351 TACCCTGTAT GTTCATGAGT TCAATTTTTT TTTTTAATTT TTAGATCCCA
366401 CAGATAAGTG AGAACATGTG ATGTTTGTCT TTTGTCTTTA TGTACCTGGC
366451 TTATTTCACT TAACATAATG ATCTCCAGTT TTATCCATGT TATTGTGAAC
366501 CATTAGATCT CATTCTTTTT TATGGCTGAA TAGTACTTCA TTGTGTATAT
366551 GTACTACATT TTCTTTATCC ATTCATCTGG TGATGGACAT TTAGGTTGCT
366601 TCCAAATCTT AACTATGGTG AGCAGTGCTG CAACAAACAT AGGAGTGCAG
366651 GTATCTCTTT AATATACTGA TTTCCTTTCT TTTGGGTATA TTCTTAGCAT
366701 TAGGATTGCT GGATCATGTG GTAGCTCAAT TTTTAGATTT TTGAGGACCC
366751 TCTAAACTGT TCTCCATAGT GCTTGCACTA ATTTACATTC CCACACAGTA
366801 TGCAAGGGTT CCCTTTTCTC CACATCCTTG CCAACATTTG TTATTGCTTG
366851 TCTTTTAGAT ATAAGCCATT TTAACTGAGG TGAGATGATA TCTCATAGTA
366901 GTTTTTATTT GCATTTCTGT AATGATCAGT GGTATTGAGC ACCAGTGTCT
366951 ATACCTGTTT GCCATGTGTA TGTCCTCTAA GAAATGTCTA TTCAAATATT
367001 TTGCCCATGT GTTGATCAGA TTATTATAGT TTTTTTCCCA TAGAGTTGTT
367051 TAAGCTCTTT ATATATTCTG GGTATCAATT CCTTGTCAGA TAGGTAGTTT
367101 GCAAATATTT TCTCCCATTC AGTGGGTTGT CTATTCACTT TGTTGATTGT
367151 ATCTTTGCCG TGAAGAGCCT TTTCAACTTG ATGTGATTTC ATTTGTCCAT

FIGURE 3DDDDD

367201 TTTTGCTTTG GTTGCCTGTA CGTGTGGGGT ATTGCTCAAG ATATTTTTGC
367251 CCAGACCAAT ATCCTGGAGA GTTTACCCCA AAGTTTTACT TGTAGTGGTT
367301 TCATAGTTTG AGGTCTTAGA TGTAAGTATT TAATTTGCTT TGTTTTAACT
367351 TTGGCATATG GTGAGAAATA GGGGTCTAGT TTCATTATTT TGCATGTGGA
367401 TATTCAGTAT TCCCAGCACC ATTTGTTGAA GGACTGTCTT TTCCCCAGTG
367451 TATGTTCTTA GCATCTTTGT CAAAAATGAG TTAACTGTAG GTGTGTGGAT
367501 TTGTTTCTGG GTTCTCTATT ATTTTCCATT GGTCTATGTT TCCATTTTCA
367551 TGCCAGTACC ATGCTGTTTT GGTTACTATA GCTCTGTAGC ATAACTTGAA
367601 GTCAGGTAAT GTGATTCCTC CAGATTTGTT CTTTATGCTT AGGATAGTTT
367651 TAGATTTTCT GGGTCTTTTG AGATTCCACA GAAATTTTAG GCTTACTTTT
367701 TCTATATCTG AAGGGTCATT GGTAGTTTGA TAGGAATTGT GTTAGATCTG
367751 TGGATTGTTT TGTGTAGTAT GGACATTTTA ACAATATTGA TTCTTCTAAC
367801 CCCATGAACA TGGAAATATT TTTCCATTTT TTGTTGTAAT CTTCATTTTC
367851 CTTCATCAGT GTTTTATAGT TTTCATTATA GATCTCCCTT CATTTCTTTG
367901 GTTAATGCCT ATGTATTTAA TTTTTTGTGT GGCTATTGTA AATGTAATTA
367951 CTTTTCAAAA ATTTCTTTTT CACATTATTC ACTGTTGGCA GATAAGAATG
368001 CTATTGATTT TTGTCTGTTG AATTTGTATC CTGCAACTTT ACTGAATTTA
368051 TCACTTCTAA TAGTTTTCTT GTGTTTCTTT TCTAACAGTT TTTATATTAG
368101 GTTTTTCCAA ATACAAGATC ATATCATCAG CAAACAAGGA CAATTTAATT
368151 TCTTTATTTT CACTTTAGAT GCCCTTTATA ACCTTCTCTT TTCTGATTGC
368201 TCTAGATAGG CCTTCCAGTA CTATGCTGAA TAATAGGGGT GACAGTAGGC
368251 ATCCTTGCCA TGTTCAAGAT CTTAGAGGAG AGGATTTCAC TTTCTGCCCA
368301 TTCAGTATGA TACTAGCTTT GGTCTGTCAT ATAGGCTTTT ATTATGAAGA
368351 GGTGCGTTCT TTCAATACTC AGTTTTTTGA GGATTTTTAT CATGAAGTCA
368401 TGTTGAATTT TATCAATTTT TTTCAGAATC AATTGAAATG ATTATGATTT
368451 TTATTTTTCA TTCTGCTGAT ATGATGTGTC ATGTTGATTT ATTTGCATAT
368501 ATTGAACCAC CTTTGCATTG CAGGGATAAT CCCACTTGGT CATGATGAAT
368551 GATCTTTCTA ATATATTGTT GAATTCAGTT TGCTAGTGTT TAGTTGAGGA
368601 TTTTTTCATC AATATTTGTC AGAGATATTG GCCTGTAGTT TTCATTTCTT
368651 GATGTGTCTT AGTCTGGTTT TGGTAGTGGG ATAATACTGG GCTCATAGAA
368701 TGAGTTTGGA ATTATTCCCT CCTTCTCTGC TCTTCAGAAG AGTTTGAGTA
368751 GGATTGATAT TAGTTTCCTT AAGACTGGTA GGGTTCAGCA GTGGACTCGT
368801 TGGGTCCCAG GCTTTTCTTT ACTGGGAGGC TTATTTAATA GCTTTGATTT
368851 TTGTTACTTT TTATTGGTTT ATTGAGGTTT TGTATTTCTT CCTGGTTCGA
368901 TCTTGGTAGG TTGCGTGTAT CTAGGAATTT GTTCATTTCT TCCAGGTTTT
368951 TCAATTTATT GGCATATAGT TGCTCATAGT AGCCACTAAT TATCGTTTGA
369001 ATTTTTGCAG TATTAGTTGT AATGTCTCCT CTTTCATTTC TGATTTCATT
369051 TATTTGGATC TTCTCTTTCT TTCTTAGTGT GGCCAAAGGT TTGTCAATTT
369101 TGTTTAACTT TTCAAAAAAT GAGCTTTCTG TTTCATTGAT CTTTTGTATT
369151 TTTTTTTCAT TTCAATTTCA TTTATTTCAG CTGTGATCTT TATTGCTTCT
369201 TCTACTAGTT TGGGTTTGGT TTGCTCTTGC TTTTCTAGTT CTTCAAGATG
369251 CATCATCAGA TTGTTTATTC GGAGTTTTCC CTCTCTTTTG ATGTAGGCAC
369301 TTGTAGCTAT AAATTTTCCT CTGAGTACTG CTTTTGCTTT ATCCCATAGG
369351 TATTTTATGT TTCCATTATC ATTTGATAAA AGAATTTTTC AGTTTTCTTA
369401 TTAATTTCTT CATTGACCCA CTGTTCATTC TGGAGCATAT AGTTTAATTT
369451 TCATGTATTT GTGTAGTTTC CAAAATTCCT CTTGCTATTA ATTTTTAGTT
369501 ATATTACATT GTGGTCAGAG AAGATGCTTG ATATGATTTC AGTTTTTTGA
369551 AGGTTTAAAG ACTTGTTTTG TGACCTAACA TATGGCCTAT CCTTGAGAAT
369601 GATCCATCTG CTGAGGAAAA GAATCTGTAT TCTGAAGCTC TTGGATGACA
369651 TGTTCTGTAA ATATCTATTA TGTGCATTTG ATCTATAGGG CAGATTAAGT
369701 CTGATGTTTC CTTGTTGATT TTCTGTCCAG AAGATCTGTC CAGTGCTGAA
369751 AGTGAAGTGT TGAAGTCTAC AGTTATTATT ATATTGGGGC CTATCTCTGT
369801 CTTTAGCTCT AATAATGTTT CCTTTATATA TATGCATGCT CCAGTGTTTG
369851 GTTCATATAT GTTTACAATT ATGATATCTT TTTGCTGATT CAACCCCTTT
369901 ATATATCTGT GTGCTCCAGT GTTTGGTTCA TATATATTTA CAATTATGAT
369951 ATCTTTTTGC TTAATCGACC CCTTTATCAT CATATAGGGA CTCTGTCTCT
370001 TCTTATAGTT TTTGACTTGA AATCTATTTT TTTCTGAGAT AAGTATAGCT
370051 ACTGTTGCTC CTTTTTGGTT TACATTGGCA TGGAATATCT CTTACCATCT
370101 CTTTATTATC AGTCTATGTG TGCCTTTAAA AGTGAAGTGT GTTTCTTGTA
370151 GACAACAGAT CAGTGGGTCT TGTTTTTTCA TCCATTTAGC CAGTCTGCAT
370201 CTTTTGTTTG GAGAGTTTGG TCCATTTACA TTCAATGTTA TTATTGATAA
370251 GTAAGGACTT ACTCCTGCCA TTTTGTGACT TGGTTTTCTG ATTGTTTTGT
370301 CATCTTCTCT TCTTTGTTTC TTTCCTTCCT GTCTTCCACA AGTGAAGATG
370351 ATTTTTCTGG TGATATGACT TAGTTTCCTG CTTTTTGTTT TTATGTTTTT
370401 GTGTATGAAG TTACCATTAG GCTTGCAAAT ACTATCTCAT AACCCACTAT
370451 TGTAACCTTA TAACAATTTA ACACTATTTG CATAAACAAA CAAACACAAA
370501 GAAAACTAAT AAAAATTCTA TGCCTTAACT TTTATCACAC TGCTTTTTAA
370551 TTTTTTGTTG TTTCTATTTA TATCTTACGG TATTCACTAT GTCCTGAAAA

FIGURE 3EEEEE

370601 GTTGTAATAG TTATTGTTTT TGATTAGTTT ATCATTTAGT CTTTCTGCAT
370651 AGATAAGAGT AGTTTACACA CCACCATTGC AGTGTTATAA CATTCTTTGT
370701 TTTTCTGTGT ACTTAATATT ACCAGTGAGT TTTGTACCTT CAGGTGACTA
370751 TTCATTGCTC ATTGATGTCC TTTTCTTTCT GATTGCAGTG CTCCCTTTAT
370801 CATTTCTTGT AGGACAGGTC TAATGTTGAT TAAATCCGTC AGCTTTTGTT
370851 TGTCAAGGTC TTTATTTCTC CTTTATGTTT GAAGGATATT TTCACCAGAT
370901 ATACTATTCT ATGATTAAAG TTTTTTCCTT CAGCACTCTT CATATGTCAT
370951 GCCACTCCCT CCTGTCCTCT ATGCTTTCCA CAAAGAAGTC TGCTGCCAGA
371001 CATATTGGAG CTCCATTGTA TGTTATTCGT TTCTTTTCTC TTGCTGCTTT
371051 TAGGAAACTT TCTTTATCTT TGATCTTTGA GAGTTTGATC ATTAAATGCC
371101 TTGAGGTAGT CTTTGGGTTA AATCTGCTTT GTCTTCTATG ACCTTCTTGT
371151 ATTTGGATAT TGATATCTTT CTCTAAAGTT TGAAAGTTCT CTGTTATTAT
371201 TCCTTTGAAT AAACTTTCTA CCCCTATCTC TTTTTTACCT TCTCTTTAAG
371251 GCCAATAACT CTTTGAATTG CTCTTTTCTA GATACTGTAG AATCTAGAGG
371301 CTATTTTCTA GATTCTGTAG ATGGTCTTCA TGGTTTGTTA TTCTTTTCTT
371351 TTTCTTTTTT GTCTTCTCTA ACTGTGTATT TTCAAATAAC CTGTCTCCAA
371401 GCTCACTAAT TCTTTCATCT GCTTGATCCA TTCTGCTATT AAAGGACTCA
371451 AACACATTCT TCAGTATACC AATTACATTT TTCAGCTCCA GAATTTCTGC
371501 TTGATTTTTT AATTATTTCA ACCTCTTTAT TAAATTTTTC TGATAGAATT
371551 CTGAATTCCT TCTCTGTGTT ATGTGGTATT TTTTTGAGTT TCCTCAACAC
371601 AGCTATTTTG AATTCTCTGT CTGAAAAGTC ATATATCTCT ATTTCTCTCA
371651 GGTGCCTTAT TTAATTCATT TGATGAGGTC ATGGTTTCCT GGTTGATGCT
371701 AATGCTAGTA GCTGTTCTTT GGTGTCTGGA CACTGAATGG TTAGGTATTT
371751 ATTGTGGTCT TCACTGTTTG GGCTTATTTG TAGTCAGTCT TTTTGGGAAG
371801 GCTTTCCAGA TATTTGAAAA GACTTGGGTG TTGTGATCTA ACTAGTACCT
371851 GCTTTAGTGG GGACCTCAGG CCCAGTAATG CTGTGGTTCT TACAGACTTT
371901 TAGAGGTACT GCCTTGATGA TCTTGGACAA GGTCCAGGAG AATTCTCTGG
371951 ATTGCCAGGC AGAGACTCTT ATTCTTTTTT ACTTTCTGCC AAACCTACAG
372001 AGTCTCTCTC TCTCTCTCTC TCTCTCTCTC TCTCTCTCTC TCTCCTGAAC
372051 CACTTAAAGC TGGAGGTGGG GTGTTACAAT TGCTTCTATG GCCACCACCA
372101 TTGTAACTGC ACTGGGTCAG ACTTGAAGCC AGCACAGCAC TAGGTCTCAC
372151 ACAAGGCGTG CTGTAACCAC TCCTTGGCTA CTGCATGTGT TCACTCAAGA
372201 CCCTGGAGCT TTATAATCAG CAGGTGGCAA AGTCAGCCAG GTCTGTTTCC
372251 TTGCCTTAAG GTTGGCAAGG TCCCCCAAAT TCTGGGTTGG TCCAGATGTA
372301 CTGTCTTGGA ATCAGGGACA AGAGCCAAAA ACCTAAGAAG TCTACTTGGT
372351 GTTCTATAAG TGCATCTAAG CTGGCACTTA AATCACGAAA TGCAGCTCTT
372401 CCCACTCTTC CCTCCCCTTT TCAAAGGCAG AGGAGCGTTC GTTTGTAGCC
372451 ACCAGCAGTT CAGGCCACAA GGAGTACCAC CAGACTACCA CCAATGTTCC
372501 CTTAAGGCCA AGGTCTCTTG CTTGTCATGA ATTCCTCCTG ACCTGGTACT
372551 CGTCCTTCAG GGCATTGGGC ACTCCTCTGG CCCAGGGCAT GTCCAGAAAT
372601 ACCATCCAAT TATCAAGTCC TGGAATATGG AGCCCCAGGA AATCACTTGG
372651 TGCTATACCC TGCCATGGTC ATGCTGGTAC CTAAGGTACA AGGCAAAGAC
372701 CCCTTTACTT TTCTTTCTGC TTTCCAAGGC AGATGGAGTT TGCCCTGTAG
372751 CCACCACCAC TTGTTATGTG CTCAGTCTCA CCTGAAACCA CCAGGTTTCA
372801 GAGGATCACT GCTGGTTATT CAGGGTCCAA GAGCTCTTCA GTTAGCAGGT
372851 GATGAATGCT GCCAAGACTG GGTCTTTTCC TTCAAGGTAG CAGGTTTCCC
372901 TCTGACCTAG AGTGTGTCTA GAAATGTCAT CTGGGAGCTA GGGCCTGGAA
372951 TGGGAGACTC ACAACTCTGA CTGATGCCCT ATCCTGCTAT GGCTGAGCTG
373001 GAATCCTAGA TACAAGATAA AGTCCTCTTT ACACTTCCCT CTCCTCTCCT
373051 TAAGCAGAAG GAAGGGGTCT CTTTTGGAAC TGTGATTTGT GCAGCCTGGG
373101 GTTAGGGGAG GCTTGATGCC AGCCCTCCCT TGGCTGTCCT AGCTAGCGTC
373151 TCAGTATATT AGGAGCCCCG CCCCCCAACC CCACCAGGCA ACTGTCTCTG
373201 GACCTATTTC AGCACTAGGA CTCACCTAAG AGTTGTAGTC CGTATGGCTT
373251 AGACTACCTT TCAAGTTTAC TTGGAGACAC AGAGTGATGT AGCCCTCTGT
373301 GATGAGGTTT GCAGGTACTC AAGTTTAGAC CACTGGGATC TTCGATTTCC
373351 CTCTGGCTGG TGTTGGTTTA AATGATCTTT TTGTGGGTGG GCACCAGGTG
373401 CGTTTGGTCT GGTTTTCCCT TCTGCCCTAA CAAGATAGCA CTGAGTACAT
373451 TGTCTCAGAA TTGCTATGTC CTTTCTCCCC CAGTGTCCAG ATATGCTCTC
373501 CCAACCATAT TGCTGCTGCA CAGGGTGGAG AAGGGTGGCT TTGGCCATTC
373551 AGAAGGGTTT TTTCATCTCT TCAGTGCCTC TTTCAGCAAT ATGAATTTAA
373601 AACCAGGCAC TATGAGTGGT CACCTGATTT TTGGTTCTTA TGAAGGTGTT
373651 TTTTCTCTGT AGATAGTTGT TATCTTGGTG TTCTCATTGA GGGGAATGAT
373701 CACTGGAATT TTCTATTTCA CATCTTTCTC TGCCCTCCTC CCTTTCCTTG
373751 TTTGTTGACG TTCCCTAGCA TGCAAAGTAA GTCATGCATG AACGGTGCAC
373801 AATAATTCTT GTTTTGCTTT GATGTGTTAG TTCTTAAGGA TATCAAATAG
373851 CAGAAGTGTA TATATATATG TGTGTGTGTG TATATATGTG TGTGTGTGTA
373901 TATATATGTA TAAAACTTTT AACCAGGAAA ATTTAAATTT AATAAATTTG
373951 AAGTTATCTA AAATAGCTTA TTTATAATTA TTAGAGGATT TGGCCAGTTG

FIGURE 3FFFFF

```
374001 ATTTTCGCAC TGAGTTCAGC AGTAGACACA CAATGGTTGA TGACCTTTTT
374051 TAAAAAAGCA AATGGGAAAA CTAGATTTAT AGCATGGATA TCAATTCTAT
374101 TTAAGGCAAG ATGAAGCTTT TTCTCTTGTG TGTCACCTTC TTTTCGATGG
374151 CTCCACTGCA CAGTGGGTAC TCCAGGGACT GTCACTGTGC TTTTTTGACC
374201 TTGACCTCCA AACATTATGA TTCATCTGGG AGCCGACACT TGGCACAGCT
374251 GAGCCAATTA GATCCCATCT TCTTTAATTT AAACTTGGAA TGGAGAAGTA
374301 TAACTGCCAA AGGTTGTTGC AGATGAATCA TTCTGGTGGC CATACCCCAG
374351 AGAAAAGATG AACAAACTTG GTGCTTGCCC TTCCAGAAGC TTTTTATTAT
374401 GTCCCATTGG TTTTTCAAAA AAGTATGCAC TACATTTATT TTTCTCATTC
374451 TGTCAGTTTG GCTTCTATTT CCTATAACTA AAATGATATT AACTATCATT
374501 TCTAGTTTGT TCTCAGAAAA CAATAATTTT AAAAATTTCT GAGAAAAATA
374551 ATTGCTTCCT GCTGACATTC CATCAGAATG TTGACTTTTA TCCACAAATT
374601 TATTATTATA ATATTATATA TAATTATCAT ATTATAATAA ATATGTTTGT
374651 TTCATAATAT ATTATTATAC TAATACACTT GCTTATTTAA AGGGCAACAG
374701 TATTGAAAAA TTTAAGAAAT GCACGGAATT TTTAGTTTTA CAATGACAGT
374751 CTTTACAGAT TGGTTCCTTG CAATTGACTC TTCAGAAACT ATAAATTTTT
374801 TATTGTTAAC ATATCATAGT TTTTCAACTG GAACACAATC AGTATTTTGT
374851 CTTTAAGGAG GATTAATGAA GGTGACAGAA CTGCATCCTA CTCTTGTGGG
374901 AAAATATCAA GAAATCAGTC TAGTTTCAAT CAGTCCTGAT GAGTTTGTGC
374951 AGACTAAAGT GACTCCAGGA AGCCTCTTCA AAGAAATTGA ATACCTTTAA
375001 GACAGATGAT GTTTTCTTCA TTGATATTTT AAAAAAGTCT TCACACATAG
375051 TTTCATAAGA GAAAGTAGTG TAGAACTAGT TCAGTATGTT TTAAATAAGA
375101 AAACTGGAAT TATGTGAGTG GTAAACATAA GGCCACAGCC TATGTTTTAC
375151 TGAAAAGTAG GTGGTTGCCT GGAACTCTAA AACCAAGAAT AGATAAAGAC
375201 AAAAATTTGT AATAAAAATG TTTAAACCTG GCCAATTTCT TCTTTGTTTT
375251 TTATGGAAGA AGAAAACAGA GATTTTAAAT CTACTTTTTT TTTCTTCTCT
375301 TGGGTTCTAC TTTGTTTTCA AGATTATTTG AAAATGCTTT TTATTTTTAA
375351 ATGGTGTACA TCTCTTTTAA TTGTTTAGCT TAATTTTATT TAATAACACT
375401 GTGCAATTGT AATTCATAAG GGCTTTCAAA TATATATCTC TAATTTTCAT
375451 GTGCCCTAAG TAGTGAATAT TTTATGCCCA TTTTGTGATG AGAAGGTACA
375501 ATCGAGTAGA GTCAATGTAC TTTCCCAAAT ATCATCACTC TCCCTGACTC
375551 AGGTCTAAAG TAAAAATTAA GTACAATTCC ATAACCCTGA AAAAATGTTA
375601 ATTATCACTA GATGTGAAAT AAATACAAAT TAAAATGATG AGGTACAACT
375651 ATAAATTCCA CAATATTAGA TAATGTGATA GATTGGACAA AAATGAGATT
375701 TCATTAAATT ATGCTATTGT ACATCTACAT TTTCTGGCAC AACTATATTT
375751 TATGACTTAG TGTCATAACT TTAACTCTCA GCTATACATT TTGAAAGTAA
375801 AGGAACATCT CATAAAAGTT ATTCACATTC TAAACTAATT TATGTAAAAA
375851 GAAATAGTTT ATTCTAGGTA GATTTTTCTT TGTCAATATC TCATGTTTTC
375901 TTTAATTAAA TTAAACATAA TGGCCTCACT TTATAATATT AAAGATGTTA
375951 GTCATTATTG GCAGTCTTAA TTTTGTGTGT GTGGTGTGTG GGTGTGCACA
376001 CTCATAGATG TTCGTGTTTT CCTGGCCGTA ACTTCAGGTA AGATCTTGTC
376051 ATGTCAGCAT TGTAAATTTA TTCAGACTCC AGACCTTCCT TTTTCATTAA
376101 ATTAACCAAT CGATGTCTAA GGCAATCAGT GGATTCTGCA GAAGCTGATA
376151 TGCCTTTTAC AGCAGTTCAG CAACAAGATT TGCTCACTTC CTTAGTTCTG
376201 TGTTACACTT TAAATTTCAT TAGCTGATCT TCCAAAATAA TAATGGCTTC
376251 ATTGTTTCAC TGAACATTTT AAAATCATCA TTGAAAGTTC GATTGGATTT
376301 ACATAGTTTT ATAGATAGAA TTATAAAATC ATATACCTGA AATGTTTGTA
376351 TAACATTAAT TTTGGAGTTG TACCTTTGCC ATGTATTTTT AAAACCACTC
376401 TAATAGCTTT AAAACAATTT CTTGAGAATA AGAGAATTAT TCTTATGAGA
376451 GGTTATCAAG TTCTATTTTA AAGCAATGAC AACTAATACA AGGTTAGAAG
376501 TAAAAGATTT TCCTTGAGTC TTACATTCTG CATCCTGGAA GCAACTTTCC
376551 AATCAACAGT TTTCATGGTT CATGGTTTCA TCTTCTAAGG GATTCTTCCT
376601 TTCCCTAGAT GCTCCCTAGC CATATATGAA AGTCAAATTT AAAATATGCC
376651 ATCCTCTACA AAATCAGTGT GCAAAAATCA CAAGCATTCT TATACACCAA
376701 TAACAGACAA ATAGAGAGGC AAATCATCAG TGAACTCCCA TTCACAATTG
376751 CTTCACAGAG AATGAAATAC CTGGCAATCC AACTTACAAG GGACATGAAG
376801 GACCTCTTCA AGGAGAACTA CAAACTACTG CTCAATGAAA TAAAAGAGGA
376851 TACAAACAAA TGGAAGAACA TTCCATGCTC ATGGGTAGGA AGAATCAATA
376901 TCGTGAACAT GGCCATACTG CCCAAAGTAA GTTATAGATT CAATGCCATC
376951 CCCATCAAGC TACCAATGAC TTTCTTCACA GAACTGGAAA AAACTACTTT
377001 AAAGTTCATA TGGAACCAAA AAANNNNNNN NNNNNNNNNN NNNNNNNNNN
377051 NNNNNNNNNN NNNNNNNNNN NNNNNNNNNN NNNNNNNNNN NNNNNNNNNN
377101 NNNNNNNNNN NNNNNNNNNN NNNNNNNNNN NNNNNNNNNN NNNNNNNNNN
377151 NNNNNNNNNN NNNNNNNNNN NNNNNNNNNN NNNNNNNNNN NNNNNNNNNN
377201 NNNNNNNNNN NNNNNNNNNN NNNNNNNNNN NNNNNNNNNN NNNNNNNNNN
377251 NNNNNNNNNN NNNNNNNNNN NNNNNNNNNN NNNNNNNNNN NNNNNNNNNN
377301 NNNNNNNNNN NNNNNNNNNN NNNNNNNNNN NNNNNNNNNN NNNNNNNNNN
377351 NNNNNNNNNN NNNNNNNNNN NNNNNNNNNN NNNNNNNNNN NNNNNNNNNN
```

FIGURE 3GGGGG

377401 NNNNNNNNNN NNNNNNNNNN NNNNNNNNNN NNNNNNNNNN NNNNNNNNNN
377451 NNNNNNNNNN NNNNNNNNNN NNNNNNNNNN NNNNNNNNNN NNNNNNNNNN
377501 NNNNNNNNNN NNNNNNNNNN NNNNNNNNNN NNNNNNNNNN NNNNNNNNNN
377551 NNNNNNNNNN NNNNNNNNNN NNNNNNNNNN NNNNNNNNNN NNNNNNNNNN
377601 NNNNNNNNNN NNNNNNNNNN NNNNNNNNNN NNNNNNNNNN NNNNNNNNNN
377651 NNNNNNNNNN NNNNNNNNNN NNNNNNNNNN NNNNNNNNNN NNNNNNNNNN
377701 NNNNNNNNNN NNNNNNNNNN NNNNNNNNNN NNNNNNNNNN NNNNNNNNNN
377751 NNNNNNNNNN NNNNNNNNNN NNNNNNNNNN NNNNNNNNNN NNNNNNNNNN
377801 NNNNNNNNNN NNNNNNNNNN NNNNNNNNNN NNNNNNNNNN NNNNNNNNNN
377851 NNNNNNNNNN NNNNNNNNNN NNNNNNNNNN NNNNNNNNNN NNNNNNNNNN
377901 NNNNNNNNNN NNNNNNNNNN NNNNNNNNNN NNNNNNNNNN NNNNNNNNNN
377951 NNNNNNNNNN NNNNNNNNNN NNNNNNNNNN NNNNNNNNNN NNNNNNNNNN
378001 NNNNNNNNNN NNNNNNNNNN NNNNNNNNNN NNNNNNNNNN NNNNNNNNNN
378051 NNNNNNNNNN NNNNNNNNNN NNNNNNNNNN NNNNNNNNNN NNNNNNNNNN
378101 NNNNNNNNNN NNNNNNNNNN NNNNNNNNNN NNNNNNNNNN NNNNNNNNNN
378151 NNNNNNNNNN NNNNNNNNNN NNNNNNNNNN NNNNNNNNNN NNNNNNNNNN
378201 NNNNNNNNNN NNNNNNNNNN NNNNNNNNNN NNNNNNNNNN NNNNNNNNNN
378251 NNNNNNNNNN NNNNNNNNNN NNNNNNNNNN NNNNNNNNNN NNNNNNNNNN
378301 NNNNNNNNNN NNNNNNNNNN NNNNNNNNNN NNNNNNNNNN NNNNNNNNNN
378351 NNNNNNNNNN NNNNNNNNNN NNNNNNNNNN NNNNNNNNNN NNNNNNNNNN
378401 NNNNNNNNNN NNNNNNNNNN NNNNNNNNNN NNNNNNNNNN NNNNNNNNNN
378451 NNNNNNNNNN NNNNNNNNNN NNNNNNNNNN NNNNNNNNNN NNNNNNNNNN
378501 NNNNNNNNNN NNNNNNNNNN NNNNNNNNNN NNNNNNNNNN NNNNNNNNNN
378551 NNNNNNNNNN NNNNNNNNNN NNNNNNNNNN NNNNNNNNNN NNNNNNNNNN
378601 NNNNNNNNNN NNNNNNNNNN NNNNNNNNNN NNNNNNNNNN NNNNNNNNNN
378651 NNNNNNNNNN NNNNNNNNNN NNNNNNNNNN NNNNNNNNNN NNNNNNNNNN
378701 NNNNNNNNNN NNNNNNNNNN NNNNNNNNNN NNNNCACCTG TAACTACAAG
378751 CTGATTTGCC ACATTACCAA TTTACCAAAT GTTTCAACAC TGTATAATAT
378801 GGGTTGCCAT TTTTCCAGCT CTAATAATTA TTGTCTTGCC TGGCCTAGAA
378851 GACCATATCA CACCTTAAAA AAATTGTTAT AGCAACACCA TACTTTTATA
378901 ACCAATTTCT GTAATAAGTC TTGCATTAAC TAAGTTATGT TGTCATAAGA
378951 AATGACCCGA AATCTCCGTG GTGGCTTACA ACAACCAAAT TTTATTTCTC
379001 GTTCACATTA TATGCTAGCT GTGGGGTTTA GTCCTGTGGC TCTTTTTAAT
379051 TCTGTACATA CAGATTTAAG GATCAGTTCT TTTCTGAAAT GTGTTTTTCT
379101 GAGGCAAAAG AAAAATAGAA AAATTAGAAT AATGTGATGG CTCTTGATAC
379151 TTCTACTTAG GAATGCCATA TATAAGCCGG GCACGGTGGC TCACGCCTGT
379201 ATTCCCAGCA CATTGGGAGG CTGAGGTCAC TTGACATCAG GAGTTCAAGA
379251 CCAACCTGGT CAATAAGGTG AAACCCCATC TCTACTAAAA ATACAAAAAT
379301 TAGCTGGGCA TGGTGGCAGG CACCTGTAGT CCCAGCTACT TAGGAGGCTG
379351 AGGCAGGAGA ATTGCTTGAG CCCAGGGGGG CAGAGGTTGC AGTGAGCCAA
379401 GATTGTAACA CTGCACTCCA ACCTGTGTGA CTGACTGAGC GAGACTTCGT
379451 CTCAAAACGT CAAAAAAAAA AAAAAAGAAA AGAGAAAGAA AGAAAAAGAA
379501 AGAAAGGGAA GAAAGAAAAA GAGAGAGAGA AAGAAAGAAA GGAAAGAAAG
379551 AAAGAGAAAG AAAGAAGGAA AGAAAGAAAG AAAGAAAGAA AGAAAGAAAG
379601 AAAGAAAGAA AGAAAGAAAG AAAGAGGAAA GAAAGAAAGA AAAATGCCAT
379651 ATACAATTTC TGTCCTCATT ACATTGGCAA GACACAGAAT CAAGCCTAAT
379701 GTTAATCAAT GAGTACAGAG GGGGAGGTGC AGTCCTCTTA GTTTGGGCAG
379751 GAAGTGATTA GGAGTAATTA TATAATCTTT TACACTCTCC CAAAATATAA
379801 GAGGAATGCA AATTAAAACA AGAATGAGAC ACCATTTGAC ACATATCTGA
379851 TTGGCAAAAA TCCAGTATGT TGATCATGCC AAAATCAGAA CTCTCATTCT
379901 CTGCTGTTGA AACTATAAAT TGACATAATC CCTTTAGAAA AAAATTAGTA
379951 ATGTTTAGTA AAGCTGTGGA GTTTATGATC CAGAAGTTTC TTATTTTTCC
380001 AGGAAAATAT TCCCACATGT ATTCCTGATG GCATGTGCAA GGCAGCTCAT
380051 CACAGCATTA TTTTTAATTG CAAATAGTGT TCAGCAGCTA AATGGATCAG
380101 CAAATTTTAG AAATTATGGC ATTTACTTAT GATGGGATGC TAAACATCAG
380151 CTGTAACAAA TAAACTGCAT CTACATGTAT CAGCATGGAT AACTCAAGAA
380201 TTAATGTAAA AAATAAATTT AAAAAATATA TTTAAAGTAG ACATTAAATT
380251 TTAAAACACA CAGAAGCATA CTATATATTA TTTATTTACG TATTTCTATA
380301 TTGCAAAAGA TATAATAACA AGGACAAGAA AGAAACAAAT CAAACTAGGG
380351 AGAAGAAGTA GCAAAACAAA GAAGAGGAAA TGGAATAAGA AGAAAGGCTT
380401 CAACTGTATC TTTAAGATTT TATTTGCTTT AGAAAGAAAT AAATACAGCA
380451 AACCATTATC ATGGAGAAAT GTTTTCATTT ATTACATCTG GTGTGTGTCA
380501 CATATATCAT ATGTTTGAAA TATTTCTTAA ATAAAGAATA AGTTATATAA
380551 GTAATGGTAA ATTTGTACTA TAAATTTAAT CTACATTATG CAAATAAAAA
380601 CAGCTCCATT TTATGTTAAG TAAAAAAATC ATTTAGAGGA AAAATATGTA
380651 CAGAGTTATA GTATTGCTGA AAGAATTAAA CATGAAATTA TGTATTTCCA
380701 AGTGGATATA CATATGTTTA TAAAAGCATA TAAAAAAATC TAGAAGAACA
380751 TAGGCTAAAT CATTAACAGT GGCTACTGAA GATGAGCAGT TTGGGATTAG

FIGURE 3HHHHH

380801 GGAAAGAGGC AGGTGACATT TCCTTTAGTT ATATTGTCTG AATTTAAAAA
380851 TTGCTATTAT TATATTTTAT AATTTTATAT TATCTTTACG ATAAAAATTG
380901 AAAGAGTTGA TCATTGAAAG CTCAGCAATG GTGATAGTTA TCTGCCACCA
380951 TGACATTATT ACATTTCATT TTGCTGAGAT GATGCTGGAA ACTTTACAAG
381001 GTGTCCATAA AATCTGGAAA TGTAAATATA ACATCATCAA GTACAATTTC
381051 TGTCTTTAAA AAATAAATAA TATTATCTAC ATTTTCAGGC TTCATTGAAA
381101 CTTTATGATA TGAGATGTGC CAACAATAAT GAGTAAGGAT AATCAATATC
381151 AAGAAAGGTG TTCTTTAAAT ACTTATTTTA AATTGTTTGA GAAATAGCCC
381201 TTGGAAACAT GAGCATTCTT GAAGAATGTA GAATCATGCA GTTCCTAGAA
381251 AGTTAGTTCA GCTGAGGGTT TTCTGAAATA AAATTATTTT TGCTTATAGA
381301 GAACAAGGAG CAGTAAAATT AAAAACAAGC CTACTGTATT TTTTTGTCAT
381351 TTTCTCCAAA CAAAATTTTA ATACTTTAAA AATGTTTGGA GTATTTTCAT
381401 GCCATTATTT AGGCTATAAA TGGGTAAAGT GCAGTGCAAC AGGGTTCTAC
381451 TTTTATCTCT TTAGAAAGAT TTATGTAACC TCAGAAATGT CCTCTATCTC
381501 TTCTCACACT TTTCACCACA AGGTCCTTTA ATTGCAGCAT TTATTTTCTC
381551 TCCACTTTGG AGATTATACA TTATTAGGTT TTTATTCAAG GGAAGCTTAG
381601 AAACATACTT GGTCTACTTT TCTTCATTTC AAATTGTAGG TCATTATGTG
381651 ACTATGACTT AGTTCAGAAA CTGTATCTTC TACCAAATAA ACCATTTCTA
381701 CTTGTATAAC AAAAATAAAA ATGAATATAT ATAGATATAT TTAAATGCAT
381751 TATGATTGGC CACAATTTTT ACGTGCTATT CCATGAGCTC AGAATCCCAT
381801 GCTACAGAAT CCCATGTAGA TCTCCCTTCT AGTTGGTAAC AGTGTATTGG
381851 AGATGGATGA GGATCTGAGT CCCCCTGAAT GGAAATAACA GAATCTCACA
381901 TAAGCTGACT CAGCACTATC TATAAGCCAT GGATACTTAT AGATAGTGGA
381951 TACAGTAGGC AGGGTCAGTA GAAACGTCCA TGAGAGTTTG GGTAATCCAA
382001 ATATCCATAG GGTGTGAGAA CATACTACAC TTTGAAAGGA ACAGTATACA
382051 GCAACCACCC TTTACTTGTA GTGATGCTAT CATGTCCATC TTTTCACTGT
382101 TACCACTTCA AAATTCATTG GCCTGACTTC CAATTGTCAG CATATTTAAC
382151 TACCAACATA TTTATGTTTT GCATGAAGAC TTTATCTTGT GGCTGGATTC
382201 CAGTTTGTGG ACAATTAGTG TCCCTTAGGA ACAGCCCTCA ATGAATGACC
382251 TATGAGAAGC TGGTGTAAAA GCACCCCAAC TTCTTTACCC CTTAAGTGGG
382301 ATAATTCTGA GGTGCATGCC ACTCTTACTG TCATAATTTC CCCAGCTGGA
382351 TTAAACTGCA GTTACTCATG TTGGTAGCTG GCATGAAAAC ATCCCCTTTA
382401 TGTGCTGCCT TAGTATCTGG AGGAACCCAA ATTAAAATAG CATTATTGCC
382451 TTCATTTTTA TGATTTTATT ATTTATGTTT TAATTGACAA ATATAAATTA
382501 TATATATTTA TGATATGCAA TGTTTTGATA TATGTATAGA TTGTGGAATG
382551 ACTGAATAAG CTAATTAATA TATCCATTAT CTCANNNNNN NNNNNNNNNN
382601 NNNNNNNNNN NNNNNNNNNN NNNNNNNNNN NNNNNNNNNN NNNNNNNNNN
382651 NNNNNNNNNN NNNNNNNNNN NNNNNNNNNN NNNNNNNNNN NNNNNNNNNN
382701 NNNNNNNNNN NNNNNNNNNN NNNNNNNNNN NNNNNNNNNN NNNNNNNNNN
382751 NNNNNNNNNN NNNNNNNNNN NNNNNNNNNN NNNNNNNNNN NNNNNNNNNN
382801 NNNNNNNNNN NNNNNNNNNN NNNNNNNNNN NNNNNNNNNN NNNNNNNNNN
382851 NNNNNNNNNN NNNNNNNNNN NNNNNNNNNN NNNNNNNNNN NNNNNNNNNN
382901 NNNNNNNNNN NNNNNNNNNN NNNNNTAACT TAACTGCTTA GAATAATTTG
382951 TAAAGGATTT GACTGCAGTC CAAACTGAGA CAAATAAACC CTTCAGTGAA
383001 ACGGCACCAT ATTTTTTATT TTCATGGGTA CATAGTAGGT ATATATATTT
383051 TTGGGGTGCA TGAGATATTT TGATACAGGC ATATAATGCC TAATAATTAC
383101 ATCAGGGTAA ATGATTATCC ATCACCTCAT GTATTTATCA TTTATTTTGT
383151 TACAAATGTT CCAATTATAC TCTTTTAGTT ATTTTTAAAT ATACAATAAA
383201 TTATTATTGA CCATAATGAC CCTGTTGTGC TATCAAATAC TAGATCTTAT
383251 TCATTCTAGC TAACAATATT TTTCTACCCA TTAACCATCA CCCCTTCCCT
383301 CTCCCCCAGT ACCTTCCCAG CCTCTGGTAA TGATCATTCT ACTCTCTATT
383351 TTTGTGAGTT CAATGGTCTT AATTTCTAGC TTCTACAAAT GTGTGAGAAT
383401 ATGCCAAATT TGACTATCTG TGTCTGGCTT ATCTCATTTA ACATAATGTC
383451 CTGCAGTTCC ATCTATGTTG TTGCAAGTGA CAGAATCTCA TTTTCTTTCA
383501 CGGCTGACTA GTATTCCACT GTGTATATGT ACCACATTTT CTTTATCTAT
383551 TCATCTGTTA CCATTAACAG ATGAACACTT AGGTGGCTTC CAAATTGTGG
383601 AGTTTGCACG TAGTGCTGAG ATAAATATGG GAGTGCAGAT ATGTCTTAGA
383651 TATACTGATT TCCCTTCTTT GGGGTATATA TCTAGAAGTT GGATTGCTGG
383701 ATCATATGGC TGTTCCATTT TTTAGTTTTT TGAGGCACTT CCAAACAGTT
383751 CTCCATAGTC ACTGTACTAA TTTACATTCC TGCAAGAGCA TATGAAGATT
383801 CCCTTTTCTC TCCACCCTGA CTAGTATTTG TTATTGCCTG TCTTTTGGAT
383851 AAAAGTTATT TTAACTGGGG TGAGATGATA TCTTATTGTA TTTTTGATTT
383901 GCATTTCTGT GATAATCAAT GATGTTGAAC ACCATTTTAT ATAACTATTT
383951 GCCACTCTAT GGGTTTTTTT GTTTTTTATT TTGTTTTGTT TTTGACTGAG
384001 TCTTGCTATG TTGCCCAGGC TGGAGTGCAG TGGCATGATC TCAGCTCACT
384051 GAAACTTCTG CCTCCCAGGT TCAAGCCACT CTGGTGCCTC AGCCTCCTGA
384101 GTAGCAGGGA TTACAGGCAC AGTCATGACA CAGGGCTAAT TTTTTGTTTA
384151 GTAGAGATGG GGTTTTGCCA TGTTGGCCAG GCTGGTCTCG AACTCCTGGC

FIGURE 3IIIII

384201 CTCAAGTGAT CCACTTGCCT CGGCCTGCAA AGTGCTAGGA TTACAGGTGC
384251 CTGACCGTCT TCTTTTGAGA AACATCTACT TAGATATTTT GCCCATTTTT
384301 AAACTGGGTT ATCAGATTTT CTCCTGTAGA GTTGTTTGAG CTCCTTATAT
384351 ATTCTGGTTA TTAATCCTTT ATCAATGGGT GGTTTGCGTA TATTTTCTTC
384401 TATTCTGTGG GTTGTCTCTT CACTTTGTTG ATTGTTTCCT TTACTGTGCA
384451 GAAGCTTTTT AACTTGATGT GATTTCATTT GCCCATTTTT GTTTCAGTTG
384501 TCTGTACTTA TGGGGTATTA CTCAAGAAAT TTTGCCCAGG CCAATGTCTT
384551 GGAGTTTCCC CAGTGTTTTC TTTTAGTAGC TTCATAGTTT CAGATCTTAG
384601 ATTTACGTTT TTAATCAATC TTTATTTGAT TTTTGTATAT GGCAAGAGAT
384651 AGGGATGTAG TTTCATTCTT CTGTATATGG ATATCCAGTT TTCCCAGCAT
384701 CAATTATTAA ATAAAAGACA AAATAAAAGA CTGACCTTTC CCCAATGTGG
384751 GTTCTTGGCA CCTTTGTTGA AAATGAGTTC ACTGTAGCAG TACGAATTTA
384801 TTTCTGGGTT CTCTATTCTG TTCCACTGGT CTTCGTGTCT GTTTTTATGC
384851 CGACACTATG CTGTTTTGGT TACAATAGTT CTGTAGTATA ACCTGGAGTC
384901 AGGTAATGTG ATTCCTCCAG TTTTATTCTT TTTGCTCAGG ATAGCTCTCG
384951 CTATTCTAGG TCTTTTGTGC TTTCATATAC ATTTTAGGCT TACTTTTTCT
385001 ACTTCTGTGA AGAATGTCAT TGGTATTTTG ATAGGGATTG CATTAAATCT
385051 GTAGATTGCT ATGGGTACTA TAAACATTTT AACAATATTT ATTCTTCCAA
385101 CCTATGAACA TGGAATATCT TTTCATTTTC TGTGACCTCT TGAGTTTTTT
385151 TGCATCAACA TTTTACAATT TTAATTGTAG AGATTTTTCA TTTGTTTGGT
385201 TAAGTCTTTT TAAGGTACTT TATTTTATTT GTAGCTATTG TAAATGGGAT
385251 TAATTTCCTT GATTTCTTTT TCAGATTGTT TGCTACTGAC ATATAAGAAT
385301 ACTGCGATTT TTGTATGTGA CTATGTATTC TGCAACTTTA CTGAGTTTAT
385351 CAGTTCTAAT AGTGTTTTTT TGGTGAGTCC TTAAGTTTTT CCCAATATAA
385401 GATTATAATA TCTGCAAACA AGGATAACTT GATTTTTTTT TTCTGATTTG
385451 GTTGTCCTTT ATATCTTTCT CTTATCTGAT TGCTCTAGGT AGGACTTGCA
385501 GTATTATGTT CAGTAACAAT GGTGACAGTG GGCATCCTTG TCTTGTTCCA
385551 GATCTTAGAG GAGAGGCCTT CAGTATTTTT CCCATACCCA CAGTATGACT
385601 TTAGCTATAG ATCTGTCATA TACGGCTTTT ATTATATTTA GGTATGTTTC
385651 TTCTAACCCC AGTTGTTTGA GAGTTTCTAT CACGAAGGGA TATTGAATTT
385701 TATCCAATGC TTTTTCAGCA TCATTTGAAA TGATCACGTT TTTTGTCTTT
385751 CATTCTGTTG ATATGATATA TCACATTGGT TGATTTCAAA ATATTGGACC
385801 ATCCTTGCAT CCTGGGATAA ATCCCACTTG ATGATTTTGC TTATTTATTC
385851 AAAAAAACAA CTTTTCATTT TTGTTGATCT TTTGTGTTTT ATTGTTTCAA
385901 TTTTATTTCT TCTCTGATCC TTATTATTTC CTTTCTTCTA ATTTTGAGTT
385951 TGGTTTGCTC TTGCTTTTCT AGTTCTTTAG TTTGTAGAGT TAGGCTGTTT
386001 ATTTGAAGTT TTTCTACTTT TTTTGATGCA GGTGCTTATT GCTATCAATC
386051 TCTATCTTAG TAGTGAGTTC ACCATATTCC ATAGGTTGAA ATATGTTTTG
386101 TTTTCATTTT CATTTTTTTT CAAGAAATTT TACAATTTCC ATCTTAATTT
386151 CTTCTTTTAC CCACTGGTCA TTAAGGAGCA AATTGTAAGA TTTTCATGTG
386201 TTTTGATAGT TTCTAATGTT CCTCTGGTTG TTGATTCCTA GTTTTATTCT
386251 ATTGTGGTCA GAGAAAATAC TTGATATGAT TTAATTTTTT TGAAATTTCT
386301 AATACTTGTT TCATGGCCTA ACATATGGTC TATCCTTGAG AATGATCTAT
386351 GTGCTGAAGA GAAGAATGTG TATTTGCAGC CATTAGATGA ATTGTTCTAT
386401 AAAAATCTAT TAGGTCTATT TAATTCAGCA GTGTAGATTG AGTCCCACTG
386451 TTTGTTGTTG ATTTTCTGTC TGGAAGATCT GTCCAATGCT GAAAGTGGTG
386501 TGTTGAAGTT GCCATCTATT ATTGTATTGG TGTTTTTCCC TCTCTAGCTC
386551 TAATAATATT TGCTTTATTT ATCTGGGTGC TCCAGTGTTG GGTTCGTATA
386601 TATTTACAAC TGTTATATCC TCTTACTGAA TTGACTCCAT TGTCATTGTA
386651 CAATGACTAT CTTTGTTCTT TTCATAGCCT TTGTTTTGAA ATCTATTTTG
386701 TCTGACTTAA GTATAGCAAC ATTTTTGGTT TCCATTGGCA TGGAATATGT
386751 TTTACCATCC CTTTATTTTC AGTCTATGTG TGGCTTTACA CGTGAAGTGT
386801 GTTTCTTTTA GGCAATATAT GATTGGGTCT CATTTTTTTT GTTTTGTTTT
386851 TTAATCCATT CAGGCACCTT ATGTCTTTTG ACTGGAAAGT TTAGTCAATT
386901 TACATTCAAT GTTATATTAA TAAGTAAGGA CTTACTTCTG CCATTTTGTT
386951 ATTTGTTTAC AGCTTGTTTT GTGGTCTTCT CTTTCTCCCT TTCCTTCTTT
387001 CTGTCTTCCT TTTTATAGAG ATGATTTTCT CTGGTGGAAT ATATTCTTGC
387051 TTTTTACTTT TTGTGTAACT GTTGTAAGTT ACTTTTGTGT AACTGTTTTT
387101 GATTTGAGAT AGCCACGAGG CTTGCAAATA GCATAACTCA TTATTTTAAA
387151 CTGAGACAAC TTAACATTTT TTGCAAAAAC AAGCAAACAA GCAAAGAGAA
387201 GATTAATAAA GACCCTTTAT TTTAACTTCA TCCCAGCCCT TTTACCTTTT
387251 TGTTGTTTCT ATATATATCT TATTTTATTG TTAATGTCTT GAAAGTGGTA
387301 GTTGTTATTT CTGATAGGTT TATCTTTTAG TCTTTCTAGT CAAGAGATGA
387351 GTAGTTTATA CATCACAGTT ACAGTGTTAT AATATTCTGT GTTTGTCTGT
387401 GTACTTACCG TTACCAGTGA TTTTTGTACC TTCAGATGAT TGTTGCTTGT
387451 TAACATTATT TTCTTTCAGA TTGAAGAACT CCCTTTAGCA TGTCTTAGTA
387501 AGACAGGTCT GGTGTTGATG AAATACCTCA GCTTTTGTTT GTCTGGGAAA
387551 GTCTTTATTT TTCTCCATAT TTGAATGATA TTTTCACTAG ATATACTATT

FIGURE 3JJJJJ

387601 TTAGGGTAAA AGTTTTTTCT TTAGCACTTT AAATATGTCA TGGCAGTCTC
387651 TCTTGGCCTG TAAAGTTTCC ACTGGCAAGT CTGGTGCCAA ATGTATTGGA
387701 GTTTTCTTTA TGTTATTTGT GTCTTTTTTC TTGATGCTTT TAGGATCTTT
387751 TCTTTATCCT TGACTTTTAT GAGTTTGATT ATTAAATGTC CCAAGTTAGT
387801 ATTATATGAG TTACATATGC TTGGTGTTCT ATACCCTTCT TGTGTATTGA
387851 TATCTTTCTC TAGATTTGGA AAGTTCTCTG TTAGTATCCC TTTAAATAAA
387901 CTTTCTACCC AGATCTCTCT CTCTATCCCC TCTTAAAGGC CAGTAACTCC
387951 TAGATTTGCC CTTTTGAGGC TATTTTCTAG ATCTCGTAGG CATTCTTCCT
388001 TGTTTTTTTT TTCTTTTGTC TCCATTTACT GTGTATTTTC AAATAGTCTG
388051 CCTTCAAGCT TACTAATTCT TTCTTCTGTT TGATCAGTTC TGGTGTTGAG
388101 AGACTCATAC ATTCTTCAAT ATTTCAACTG AATCTTTCAC CTCAAGAACT
388151 TCTGCTTGAT TTTTAAGAAT TATTTCAATC TATTCAATAA ACTTATCTGA
388201 CAGGATTCTG AATTCTTTCC CTGTGTTATC ATAAGTTTCG TCAATCTTCC
388251 TCAAAACAGC CATTTTGAAT TGTCTGTCTG AAAGATCACA TTTCTCTGTC
388301 ACTCTGGGGT TGATCACTGG TGCCTTATTT AGTTCATTTT GTGAGGTCAT
388351 GTTTTCCCAG ATGGTCCTGA TGCTTGTCAA TGTCCAGGCA TTGAAGAGTT
388401 GGATATTTAT TACGGTCATT TCAGTCTGGG CTTGTTTGTA CCCAACATTC
388451 TTGTGAAGGC TATCTAAGTA TTCAACGGGA ATTGAGTATT GTGCTCTGTC
388501 TTTGGTACTG CAGCCATATC TACATTATGA GGCACACCAA TCCCAATAAT
388551 AGTGTGACTC TTTCAGAATC GTAGAAGTCC TGTCTCGGTG GTCTTGGGTA
388601 AGATCCGAAT GAATTCTCTG TATTACCAGG AAGAGATTCT TGCTTCCTTC
388651 CCTTACCCCA AACAAATGGA ATCTCTCTCT TCATGATGAG TTTCCTGGAG
388701 CTGAGGAAGG GGTGACACAA GCACCTCTGT AGCCTCCACC ACTGGAACTG
388751 CATCCAGTCA GACCTGAATC CAGCATAGCA CTGGGTCTCA CCAAGGCCTG
388801 CAGTGATTAT TGCCTGGCTA CCACCAATAT TCACTCAAAG TCCAAGGGCG
388851 CTTCACTTAG CAGGTGACAA ATCCAGCCAG GCCTGTATTC TTCCCTTCAG
388901 GGCTGCAAGC TCTCCCTGAG CCCAGCAGAT CCAGAAATTC TGCCCAGGAG
388951 GCAACATTTG GAATCAGGAA CCCCAGGAGG CCGCTTAGTG TTCTACACCA
389001 CTGTGACTGA GCTGCTACCC AAAGCTGCAA GATAAAGTTC CCTTTACTCT
389051 TCCCTCTCCT TTCCTCAAAC AGAAAGAATC TCTCCTCATG GCTGCCACAG
389101 CTAGGAATGT ACTGGGTCAC ATCTGAAGTC AGCGTGGCCC TGGATCTCAC
389151 CCAAATGCCT GCAGCAAATA CTGCCTGGCT ACCATTGATG TTTACTCAAG
389201 GTCCAAGCAC TCTTTAGTCA TCACATGGTG GATCCTGCCA AAACTGGGTC
389251 CTTAACTTCA AGGTGGTGGG TTCTCTTCTG TCCAAGGGTG TGTCGAGAAA
389301 TGTCATCTGG GAGCTAGGGC CTGGAATGGG TGCCTCAGGA CTCTGTCTAG
389351 TGCCCTATTT TACTGTGGCT GAGCTGGTAT CCAAGTTGGA AAACAATGTT
389401 CTCTCCTTTC CCCTTTCTTT TTCTCAAGCA GAAAGAAGGA ATCTCTCAGA
389451 ATTCTGAGTT GTGCTGCCTG GGGTTGGGGG ATGGGTGACA CAAATACTTT
389501 CTTGGCCACT CTGACTTGTG TCTCACTAGG TCACATGCAC CCCAAGTCCA
389551 CTGGCTTCTA GCCCAGTACA GCGCCAAGAC TTGCCCAGAA ATTGCAGTCC
389601 TTGTGGTGTA GACTGCCTTT CAACTTTATT TAGAACCCCA TAGCATTTTA
389651 GCCCATGGTG GTGGGGCTAC CAGGAACTCA GGCTCTGACT CCCAGAATGG
389701 ACAATTCCTT TCTGGCTACA GTAGGTCTAA ATACTTCTTC TGTGGGCACC
389751 AGCTGAATTA TCTCCTGCAT TGCTTTCTAC TGTGACAGGC AGCACTGAGT
389801 TCCACTGCAA AGTCCTACAA TCACCGTGCT CTCCCTTTCC CAAACACACA
389851 GATTCTCTCT CAGCACCATG AGCCCCCTGC CAGGAAATGG GAGTGGCTGT
389901 CAGGAACTCA AGACTATCTT TTCTACACTG TTCATGCCTC TTTCCTTATG
389951 ATGTTAAAAC CAGGTACTAT GGTCACTCAC CTGATTTTTG TTCCTCCAAA
390001 GATGTTTTCT TGTGTGAGTA GTTGTTCAAT TTCCTGTTCC TGCAGTGGAG
390051 ACAATCACTA TAGGGTTCTA TCTGGCTGTC TTGCTCTGCC TGCTCACCAA
390101 AAGGCACTTT TAAGGCATTG TGGTATTTGA AAACATCACT GAAGTGGTTA
390151 TGACCCATGC AAAAAAATGT GTGTGACTGA ATCCTCCCGG TGCTGTTATT
390201 TATTCCTAGC ATACCTTTGA TTTTAGATTC AGGTTAGCTC CATATTCTGA
390251 AGTGCTTCCA ATTCTGACTT CCTGCTTCTG AAGTTTAGCC CGAGTACTAT
390301 AGAAGTCCCT CCCAGTTACT ACAGACTCCA CTTTTTTTGA GTCCACGCAG
390351 ACTGTGGCAT ACAAGCACTC TGGATTGCTC AGCAGCATTG TAAAAGGATC
390401 TATGGGGATA AGGTACAATT AGTGAGCTCC TCGCTTTGGC CCCTTTAATT
390451 CTTGAGATTT TCATTTTTCT TTGGGAACTA AAACCTAAGT ATACATAGTG
390501 ATAAAAGCTA AAGGTAACAT AATAAAAATT ATCTTATTAT TTCTTTCTTT
390551 TGCCTAACTG TGTTCTGGAA AAAACAAAGC CATTTATAAT GAAAAATCAT
390601 TAAAGCAAAA ATTCAACATT GAACATGCTA GTGTCTGAAC ATGCTTTATG
390651 TAAGAGTTAA ATAAAAATTG AGAAAACAAA GCAGTTTTCA CTGGCTTAAA
390701 GTTTGATATT TGTATATATA TAATTGCCTT CCATGATGAT GACTGATTCA
390751 GAAGGGCATG GCATTTACTT GACATGCTCT CATGGCATTC TTTCTCTCCA
390801 GTTTCCCAAG TAAGTATAGG GCTTTTATTT TTGAAATTAG TTTGGTTAAT
390851 TGCAGTTGAC CAGGGTGAAC TGGCCAAATA GAACACCAAG TACCTTGAAT
390901 GTACTTGTGT TGGCACAGGC ATATATGAGA TGAGAAAGTC AGAGACGGAG
390951 ACTTCTCCTA GCTTCTTTTC CACCTTAGCC AGTGGCAAAT ATCTTTTCTG

FIGURE 3KKKKK

391001 AAAATAATAA CAACATGCAT TTGGTTTTGA TTGTTATTAA ATTTGTGATG
391051 AGCCACAGTT GGAGGTCATG GCTGCGATTT TGTAAAATAG GGTATTGGGG
391101 AAGGAAATGA GGTTAGGCAA TTTCCTGGGC ATGATTTTTC TTACTTTTAT
391151 TCATAAAGGT AAGAATGCAC TTATAGGACA CATGCATATA ATGTAATAAT
391201 ACTTCTCATC TCTGGCTGTA CATTAAAATA ACTTGGGGAG CACTGGAGAA
391251 CTACCCCCTA CCCGTTTCAG AGATTCTGAT TTAATTGGCC TGGCAAACAA
391301 CCAGGGCATC AGTAGTTGCC AAAGTTCTTC AGGTAATTCT GATTTGCCTG
391351 TGGGCATGAG AACCACCCAT GTTCCTGAAG ACAGCATTTC CTGACCGATA
391401 GAGCCTTGAA ATTAGAACAA TGGAATCTGT ATTCTAGTCC TGGCTTCGCC
391451 AACTTGAGCA GTCTTAACCT CTGTGAAATT ATATCAGTTC TTTGAGAAAA
391501 CATAGTTATT ATTGTAACCA AGCTCTCAAA TTCATTCTGC TCTAAGAACT
391551 TGGGATTCTA ATTATCTCCT TCCAGAAAAA ACAAACAAAC AAACAAAACA
391601 CTAATGTTTA ATTACAGATA TTAACATATT GTTTACAATG TAAGAAATAT
391651 AAATATGAAT CAGATATTGT CTTTGACCTT TGGTTATTCA CTGGCTATTG
391701 TCGGATGCTG GGGGGGTGAC AATGAGTTAA CTTTAATAGA GTTTCATTAA
391751 TACAAGTAAA TCATGCAAAA TAATGGCAGC AATCAATTGT CTTTTAAACA
391801 GAGAAGTCTT AATCTCGTGA AGAAAGTATG ATTTGAGCTT AATCTCAAAT
391851 AGGGGTTATA GAGCAGCATT TGCAAAGGCT CTGGAGAGTG CAGAAAATGT
391901 TTTGGGAACA AATAGTTAAG GGTGGCCTCA TTGATTGATC CTATAGACAA
391951 GAAGTTATGA AGGCTTCCCA GGACCAGATT GTGAATGGTC TTAAACTCAG
392001 GCACTCAATC AAGTATAAGA GAAATAGTAA AAGTTTGATA GTGATATTAA
392051 AGAGCTTTGC ATTTTACATT TTGAGAAATA TTTCCCAGTT GCCCTCCAGG
392101 CTCCTTCCTG GGTCAGTGCT GCAGGGAGGC TTTAATTGGC AAGTCCGGGA
392151 ATCAAACTCA AGTCTGAACG CAAAATCCAT GAGGTCCTTC TTAACCATCA
392201 GACCATACGG CCTCAGGCTT TTCATGTATA CCATAATGAG AAAAATCCTT
392251 TCTACCTTAT AACTTTGCTG TGATTGACTA TATGAGATAG TGCATGCATA
392301 TTTTACTGCA TGCTTGATAC ATATTAAGTG CTCAGTAAAT TATATATTTC
392351 TGTCCTGTGG TGGTTTCAAC CTGGCAACCT CTGTACCTGT GTTCCCTCCA
392401 GCAATGAAAG CATGCAGACT CAGCATTTTT ACCTGTACCG CTTAGTTACA
392451 CCGTGATTGA CAGCCTCCAT TACCCAGATT CTTAGTATAG TTTCTCAGTC
392501 CTCTCATTCA ATTTAATTCA ATAGTTACTA AAATCTTGCT AGTGCTCAGC
392551 AGACCATGTA GATGGCTGTG TATTAGGAAT AAGAGGATGC AAAAATGAAT
392601 ATGGCATACT GTCTTCATTC CGGGAGCCTG CAATCCAATA GTGAAAATAG
392651 ATGTAGTCAT AAATATTTAA TACAAGGCCA ATGTGGACAT AGCTTTGATT
392701 GCCTGCTGGA GGCAGAGAAA GGGCAGTATG TGAAAATGTG ATAGTTCTTT
392751 GTAGTTTATT TTTTAATTAG GCCTAAGTAA AATGGTTGGT TTAAGTTGTA
392801 AACATTTGAC AAAAAGCCTA AGGTACTTTG GCTCAGAAAT TACAGATGAA
392851 TTATAATGAA ACTGCATATT AGAAAATAGA GGAAAACATG TCTAAATGCT
392901 CAGTTTGTGA ATTGTATCTA TCTTTCAATA ACCATGCAAA ATAAAAGCCA
392951 ATGTATTAGC TTGACAATTG TTCTGCATCT CTACTATGTC CAGCATATCA
393001 AAATATGTTA CAGAATTCAG TAAAGGAAAA TTTATTTCCT CCAATAAATT
393051 ATCAAACAGT AAATCTTGTC AGTTTCTCTA ACGTGTCTTA ACTTCAAATC
393101 ACTGATGTAT TTACTCACTA AACACATCTA TAAAAATGGC AATCCTGGAA
393151 AATTGTCTGG GGTATCTTTT GATTAGCATT GGTTTTTGTT TGTTTCTTCA
393201 ATTTTATATA ATTATTTTTC ATAGTTACAG TCAATATAGG AAAATTGAAA
393251 GTTACCAGAA GCCTAAAATC TGTTAACAGT TTGTACTAAA ACTTGAATTC
393301 TTAATTGGGA TGCTTTTATC CTGTAAGCAA TTTTTGCAGG TCACCTGATT
393351 CACATTAGCT AATCTCCTAG AGAAAATTAA ACATACGAAC ACTATTTATT
393401 AAAGTGAACA TCTCTACAAA ATAATATTAA TGACTAGAAA TCCCTCAGAA
393451 AGCAAATATT AAGTCCTTTT ATCCATTTGT TAACATTTGT TTTCAAGTTA
393501 AATTTGTATA ACATTAAGAT ATTGTAATTG CAGTGCTTGT ATCTTCCATC
393551 ATACTGCACT GCCTTAGTGT TCTCATCTGC AATGCAATAA TACATATTGA
393601 GTAAAGCTAA ATCTGGCTTC CAACCTTAAT TAAGAAAGTG CTGTTATATG
393651 CAGCAACACA TAGGCCTTGC ATTTCCCAAT GCCCAGTGAA GACGTAAATT
393701 CCTCACTGCC TGAATTAATG CTGGCACACA GGCACATAAG GACCAGAATC
393751 TTCATCACCA GCTCATAATT TTTGATTGCT CATCGTTGGC AAAGTACTCT
393801 AACTAGGCAC TCTAATGGGC ACATACATAA CCAAACATGC TGATGATGCT
393851 GTTTTTACAT CTGAGGGTTC TATGTGAGCA AAAGAAGCCT TGAGGAGATA
393901 ACAGAGTAAT GCTGAACATG GCATTTTATG AACTAAGGAA AATTACTGAA
393951 AGACTAGAGA CATAAATGAA TATTGCCCCT CAGATAGAAC TCATATATAC
394001 TCTTCATACC AGAAACTCCT TTTTGATACT CAAAAGGTAG GCTCTCTTTC
394051 TGTGAACAAA GATAATATTT ATAGTAGAGC TACCGAGGAA GATATTAAAA
394101 TTGATAACAC TCTGAAGAAG CTTGAGGTCA ATGCTTTGGT AGGGGCATCC
394151 TAAGGGGTAT CTTGGAGAAA GAATATTAAG GGATATTAAA ATCTTTTTTT
394201 TTTTTTTGAG AGATGGAGTC TCGCTCTGTC ACTCAGGCTA GAGTACAGGC
394251 ACCATCTTGG CTCACTGCAA CCCCTACTTC CTGGACTCAA GGTCTCCATG
394301 GTACCTGAGA TTATAGGTAC CTGCCTCCAT GCCCGGCTAG GTTTTTTGTA
394351 TTTTTATTGG AGACAGGGTT TTGCCATGCT GGCCAGGCTT ATCTTGAACT

FIGURE 3LLLLL

394401 CCTGACCTCA AGTGATCCAC CCACCTCAGC CTCCCAAATT GCTGGGATTA
394451 CAGGCGTAAG CCACCGTGCT TGGCCAGATA TATGTCTTCT TTAGTGAATA
394501 GTAATAACAA TTTACCCATA ATTGGGCTGG AAGATAGTTG AACTTGTGTT
394551 GACTATAGGA GTCATACCCA CCAATTCAAC AAACACTTTC TGAGCAAACC
394601 CCTATTGCCA AATACTGTTT TATGTACTAT GGATAAATCA TAAATAAGAA
394651 TAATGTTTTC TGCTCTTGAG AATAGCAGTA AAAAGTAAAG TAAACAAAGT
394701 CAACTTATAG TATTATGCTG AATATAGGAA CATGTGATAT GATAGGGACT
394751 TACTGGCTAG AGGATCAGTC TGAAAGCATG GATATCTTTG GGGTAATCCA
394801 GAAAGAGCAA GAACACCAGT GTGACTGGCA CCAAATGATC ATGGAAGAGA
394851 GGAGTTGGAG AGGTAGGCAG GGGGTCAGCT CTTACAGAAC TGCCCAACTG
394901 CCCTCTGACA ATGTGAGGAG TTTGAATTTT ATTCTAAGTT TAATGCCATC
394951 AATTAGAGGC TTTATTAAGC AGGGGTAAGT AAATGTAGAC TCTAGAGTCT
395001 CTGCTTCTAA GGTTCATTGA CGTATTTACA AGATCACTCT GATCATAGTG
395051 TCAAAATTAT GTTGTAAGGT GGTAGAGGCA AAAGTAGAAA GAGTCATTGG
395101 GATAATTCAA GCAAGAAATC AAGGTAATGT GGAGTTGGAT ATTAGCAGTG
395151 GAGATGGAGA TAAAGGGACA GATTTAACAT GTATTTAGGG GTTAGAGCCA
395201 CAGGAACTCA CATAGCGATT TGCCTGCTTG AGGCAATTAG GAGACCACAT
395251 AAGACTTTTG ATGTGAATAA GGATTGTTTG TAAGGGTAGA GAAGTTGCCA
395301 CAAAACAAAG CATCATACCC AATTTTTAAC AAAACCGTGT AGTGCCTCTG
395351 CTACAGAAAT AGTATAGGTA GTGCAGATTA TAATCCATAA AGGAGAAGAA
395401 AAGACATGGG AGATGAATGC AGAAAAAAAT CTAATGAAAT ATTTAAGGGA
395451 CAGAAGTCTG TGAGATGATT GTGGTGTGGA GGGAAAAAAC AAAAAAACAG
395501 TTTGGGAGTC AGGAGTCAGG AGTCTTGAAC TCGGAATCCA TCTCAAGTAC
395551 TAATCCAAGG TATAATTCTG AGAAATGAGC TTTATCTTTT GAAAGTCCTG
395601 TCTCCTCATT TGTAAAAGAA GAGTGATGTG GAAGAAGATT GTCTCTATAG
395651 TCACTAATAG CTTAAAATGT TCATTACCCC ATTAGTCTTT TGCTTTAGAA
395701 AAATAATGGC TGATATACCT AATGCTAGAT GATGAGTTAG TGGGTGCAGC
395751 GCACCAGCGT GGCACATGTA TACATATGTA ACTAACCTGC ACATTGTGCA
395801 CATGTACCCT AAAGCTTAAA GTATAAAAAT AATAAATGAA AAAAAAAGAA
395851 AAATAATGGC TGAAAGATGC ATGATGAAAG GTTGTATAAT TATGTGTTCT
395901 AAACAACTTT TTTTTACTAA GTGACAGTGT ATTTTAAACT TAGAAGAGTT
395951 AAGAACTTAG AAAAGAGTAA ATTTTATCCA TATGAAATGC AACAGTGTTT
396001 TACTTAAGGA ATAGTGAAAT TGTGGAATAT TTGCCTTAAG TATTGACATA
396051 GTTATACATT CTCCAAATAG TTAATTAATT TCCTATGTAC TAGGCTCCAG
396101 AAATATAAAC ATTTTTACAT GGTTAGATAA ATCATATATA AATGAATCAT
396151 TACAGAGCAC TTACCATGTA CTAGGGCCTG AATCATTACA TAGCACTTAC
396201 CATGTACTAG GGCCTAAGCA CTTTAGAATT ATTAATTAAT TCTCAAGATA
396251 GTTGTACAAG ACAAGTATTG TTTTCTTCCG TTCCACAGAT GAGAAAAATG
396301 AGACTCAGAG AAATTAACTA ACTTGTCTAA GGTCACAAAG TTAGTAAGTG
396351 GATGGGCCAA GATTTGGATC CAGGATTTCT GGTTCTAAGG TCTCTGCCCC
396401 TAAATGCTAT ATTATATCTC AGATTTATAA ATGAAAGACT GTGTTCTTTC
396451 TATGAGAATT TAACGCAGAG AAGAAGTTTC TATATTTTTA TGATAAATTA
396501 TTCTCCATCA TTTTGGGAAA AAACAAAGAC ACTTAAATCC GTGGAAAGGA
396551 ATTATGAAGT AAAAAGGAAA ATTTATAAGT CAAAGACTTT TTATGCATTC
396601 AGCAGAGTTG ACTGAATAAA TAGAACATAC AATACAGATT TGTTTACACA
396651 ATCCACAGTA GAGTAAGTTT CAAGTGGATT CATTTACAAC AGGCATTTTG
396701 CCTACTAATC TTTACAATCA GCTGAGTAGA GTAATTTAGA AGATATGATC
396751 TTCCTAAGGG ATAAAGGGAG AAGGGGAGAA ATGTTTTTGG ATATATTTTA
396801 GAACTTATAT TTTCCATTAA AATTACATAG AAAAATTGGG CAATTATAGG
396851 TTTGTAACTC TTGCAAATCT TGGACTTCCT TCAAACCATC AACTAGGTTA
396901 CCACAAAATT AAATTCACTT GTTTCACAAA AGCACTCATT CCAATCAGTT
396951 GGAAAATGTA GAAAGGCTTG TTTCTTCTGG ATTACCTTTA TGCCACAAAG
397001 CAAACATAAC CTATTGCTTT TGCTTGTTTT TCTTTGGTTT GATGTATATG
397051 AGGGAATAGA AAAGTTAAAA ATGTTGAGTA TGAAAATTTT AGGTAAGATC
397101 TAAATAGAAA AGTTTAAAAT ATTTAGTATG AAATTTTAGA TAAGAACTGA
397151 CATTGAAAAA CTTAAACATG TTTGTTGAAT TATAAAGTGC CCTTTCAATT
397201 ACATAAGATA GAATTTATTT ATTAAATATA ATTATAGTAT TATACTATAC
397251 ATTTTAAATT CGATTTTTTG GGAAATGGCA ATTCATTTAC TATGTACAGA
397301 TTATCCTTGA ACAATATGTG TTTGAACTGC ATGGCTCCAC TCAGACGTGA
397351 ATTTTTTTCA ACCAAACACA GCTCCAAAGC ACAGTATGCA TGGAATGGGA
397401 AACCTATGTA AACAGAAGGT TGACTTTTCA TATGCACAGG TTTCACAGGG
397451 CTGACAGTGA GGCTTGAGTA TGGGAAGATG GTATACCTAG GGGTCTTGGA
397501 ATCAATACCC CACTTATACT GAGGGAGGAC TATACATGAC TGGAATATTT
397551 GGTCAGCCAT TACAGCTATT TTCCTGACTA TTTTGTGTAT AGCAGAGTTT
397601 CTTTCTTAGC AATGAAAATT TTTGTGGGCT GATTGACCTT AGGTAGTTAA
397651 CTTTTAATCA TCGCTCATGA TGATCCAGAC ACCATGCTAA ACATGTTACA
397701 TAAATTGCAT TATGCATCAT CTCAACAGAT AGTTATAATA CTATTCTTGT
397751 CTCCATTTTA CAAAAGAATA AATTCAGACT TACAGGAGTT AAATAACTTA

FIGURE 3MMMMMM

397801 CATAAGGAAA TATATTTCAG CCAATAGGAT TTGAATGTAA GGCTTCTGCA
397851 TTAAAAGATG CATACATCCT GTCCACAATG ATATGGTCAA TATTATTAAG
397901 AATATTAAAT ATATCTAATA GTTATGTCTA AGCCGCACTT AAAGTTTATC
397951 TTGTTTTTTG CCCTCAGTCT ATTTTAAGCA CTATTTTTTA AGTTGTTTAT
398001 CTTTACAATG CCACTTTTTT CTGTTCTCAC CTTCATCGTC TTTGTTTACT
398051 GATAAATATT TCTTGTCTGG GTCAATGACT TTGTCTCCTA CCTGGTCTCA
398101 TTGCTTCTTT TCTCACGCTT CTTTAATAAA TTTGGTATAC TGTCAACAGA
398151 ATCCATGTAT GTAAACTCTT TATCCTTAGT TCAAAAACTT CTGTGTTTAG
398201 TATAACTATG GAATTCTTTA GGCCGCCTTA TAAGACCCTT GATAACCATA
398251 CCCTATTAGC TACCTTATAT ATTCCATCTT TATACCATTC ACTTTTTGTT
398301 TTATTTGAGT TCGTTTCCTC TCTTTATATA GAATTTTGTG ATACTCATTT
398351 CCATGCTTAC ATCTATTTGC TCATTCTTCT CATTCTACCT TTCCATAGAA
398401 AAGGTCCAGT TAAAATGCCT CATCTCCAGG CTAAGAAGCT GATTCGAGCT
398451 ACTCTACTTG ATACTAATTT TTACCCTTGT TGAAACTCCA GGTGTTTATT
398501 AATATACCGC CAATGAGTTA TTTAATCTCC GTGTCTAATA TTATCTTATA
398551 AGTTGAGGTT TATACTCATT ATCTCTTCAG GGACTAGGTT TTATTCAACC
398601 TATACCCCCC TACTTCTCTA TTAAATCCTG AATGAATAGT AACTACAACT
398651 TATTATACAT TTATCAAAGT TATTCCACTT CAGAATAATC AAAGATGATT
398701 GTACTTGATA ATGCAGTATT AGCCAAACAG TTCTTGCAAT AACTGTTATT
398751 TTTATATTAA TTCTGTAGTT TGTAAAAGTG CAAAAATGAA AATTACATAT
398801 GCTTTCAAAT TAAAATATGT AGTCAAACAT GAGAGCTAAA TATATTCATC
398851 AATATAGCAA TTTGAGACAA AAGTACTAAA ATTGCGGGCT TCAACATAAA
398901 AGTGTATATT ACAATTTGCA AATAACTCTA AATAGTCAGT TCTTGAATAT
398951 GGTATTTCTT TGATAATGGA TACAGTAAAA TGTTATGTTA ATTCCAGGTG
399001 TCTTTTGCAA GTGCTCTTTC AAAAAAAGCT GTATCAGAAT ATAATGTAGC
399051 AATGTTGACT GAATATAAAA AAATTGGTTG TATAAGTCAA AGAATATCAA
399101 GGGTCACTTA TTTATTTTGT TAGTCATTTA TCAGATACTT ATTGAACACC
399151 TAATATTTGC AAAGTACGGT CTTAGAGTAT GAAAATTTTA ATACAAAGAT
399201 AGTTTATTCT CACAAGTGCC CATACTCTGA TGTTAAGATG GTCAAGGAAT
399251 CAAACCACTG CAAAACAATC AAATACTTGT GTAATAGCAG CACATGTGAT
399301 ATGCAACAGG AACAGAGAGG AGAGACAAGT TTGTGTATGT TGATAACGCA
399351 TTTGTCTGGT CCAGTAGATT ATTTTAGCTC AGTGACTATA ATATGTTCCA
399401 ATTTATGGAA ATTTGATATG CATATGTATA AAATTGATTA ACTGGGAGGG
399451 GTTTGTTTTG CATAAAACAA GGCCTGCTAA GAATTTTTCT GCTATGTTTA
399501 AAATATTTAC ACATGGATGA ACATGTGTAA AAAATGATTT ACACAAAATT
399551 TTGTATGTGT ACAGCTTTTG ATTAATGGAA TGGATTTATA GCTTTATAAT
399601 AGAAGACTGT CCTTATGGTT CCAGGTTTTC CAGTAGAAAC ACTTGTTATA
399651 GGTTCATGAA ATGCTAGAAC TGCTTTTGCA GAAGAGCTCC TGCTTGCCAT
399701 GAAAATTGGA TTATCCAAGC ACCAGCTTAC AGATGATCTG CCTGGGTGAG
399751 AAATAGTCAT TGGGAAACTC AGGCTCAGGC CAACAGCATT AATATATGGA
399801 ATGGCTATAT AGGGGGATTT GGTATGAGCC AAATCAAGGA ACCGTATTCC
399851 AATCAGACCC ATCACATCTG TAAAACTGAC ATGCCCTAGT CTCTGGTGAT
399901 TACACAGCCA CATAGAGCTA TTGCAAGCAG GGCATTAGAA GTTCTGAATC
399951 TCGAGTGTCT GCTGTTGCTG CATATAGCAT TTCACCCTTG AATGTGCCCT
400001 TGTAATCCAT GAGAATCTGT CATATCCAAA CCATGCTGAA TCGATATAGG
400051 TATTCTACTT GTACTGGATA GAAGATGCTA TTCCAGTTTT CTTCAATTCA
400101 ATATTTACAG AGCATTCCAA TGAAATGTTG ATCAAAGTTT TGGCAAGCTA
400151 TTTTAAAATA TTAATGGAAA GGTGGTAAAT AAACTATTTA GTTACATGAA
400201 TAGTTGTTAT TCAATATAAA ACCCTAATTG CAATAAATAA TACAAAATAA
400251 AACTCAAAAT ATCATTATGA AGTTCAGGCA CTACAGCTGG ACTGTAAAAA
400301 TGGAGGGCCG CAGGCTGGGT GCAGTAGCTC ATGCCTGTAA TCCTAGCACT
400351 TTGGAAGGCC ATGGTGGGTG GATTGCCTGA GCTCAGGAGT TCAAGACCAG
400401 CTTGGGCAAC ATGGTGAAAC CCCGTCTCTA CTAAAATACA AAAAAAATAG
400451 CTGGACATGG TGGTGCATGC CTGTAGCCCC AGTTACTTGG CAGGCTGAGG
400501 CACAAGACTT GCTTGAACCC TGGAGGTGGA TGTTGCAGTG AGCCAAGATC
400551 ACACCACTGT ACTCCAGCCT GGGTGACAGA GCAAGACTCT GTCTCAATTA
400601 AAAAAAAAAA ATGGAAGGCT ACATATGGTG GAAATACATT GGGAACATCC
400651 ATCTACTTTT CAACCAATGG TTCAATGATA CAAATAATCA TTTAAACCTT
400701 GTATGATAAA TACAAACACA TATTATGTGA AAACTTACCC ATGGAGAAGA
400751 TGGATTCGAT TAAAAAGCTT AGAAATTTTA AGTCATATTG TAGTATATTA
400801 TCTTTACAAT TTTGAAGACA GCAGATAGTG AATATTTTTT ATGTCTGCTT
400851 TGCTGTTATT CTATAATATT CTCATGTAAT TTTGACTAAT AAGTGTACAT
400901 TAACTATGTG TACAAGCAAT GATACATTCA TATTTGCACC TCTGCTTTGT
400951 CTGCAGTATT GTTCCAGTGA ATTAGCACAC ACAGAATACT TAGTATTAAG
401001 TAATTAACAA TGGAATTGAG AAGAGATGCT TCTTTATATG AAATGATAAA
401051 TAACAGGTAT TAAGATGAGG ATGCATATGA TAATTGCAAT GGTAGGCTAC
401101 AGAGGAAGAG ATAAATGTGG TAATTATTAC CAGGAATGTC TCATGTCACA
401151 CACACACACA AACACACACA CACACGTATT TGTATAATGA AAAGATGTAC

FIGURE 3NNNNNN

401201 CAAAGTTTCA GCATAAGAAT CAGAGACACC TGGCTTCGAG AGCCTGGCTT
401251 GCTTACGTAT CATCTCTGTG ACCTTCAGCA ACTGCCTGAG CTTTCATCTC
401301 CCTATTTGTA AAATGAGGAC ATTAATACTC ACATCATTGG CTTTTTGTAA
401351 GACTTAAATA GAATAAATAT ATAAAACATC AATTTGTACT GGATGAAAAT
401401 TGTGATTATT GTATTGATTG CCAGCATGAT TAATAACTTT CTATAAAAAT
401451 GTATGCTTTC CTTGCTTAGT AAAAATTGTA TAGTTATAAT TCAATAATTT
401501 TTACATTATT TTCCTGTCCT ATTCAGCTAC AGAAATGACA CAAAATATAT
401551 GACAGTGGGA CATTCAAAAT TGTCAGATTG AAAAATAGAT TGTAAATTTG
401601 TTGCTAAGGC AGCAGAATAT AGGGTTGTCA AACTTTACTG AGGTGTCAGA
401651 GTATGTGATA CTTTCAGCAG TGATGAGTGA GTTTCGTCAA AATGTTCAAA
401701 TCACACATAC AATTCATTCA ATTGAATTGA ATACGATTCA ATTCTAGGTT
401751 GAAAGACGAA TGTCTTACTT ATTTTTTACA GAAAATGAGG TGACCACATA
401801 AAACATTTTA ATGAAATAAA AGTTGTGTAA TACATTTTTA TTTCTAAGTT
401851 TTGAATAAAG CAATATTAGT TTCACCTCTT ACAAAAAAGA AATATGGTTA
401901 ATATAATATA AAACAATTAG CTAAAACTGT ATATGCCAAT TAAATCTTAC
401951 TAAAGACTGT TTTGTTATAG TATTTATAAT CTGAATATCC TTATTATATT
402001 AGTTCGTTCT TACACTGTTA GTAATATAAA GAACTGCCAG AGAATGGGTA
402051 ATTTATAAAG AAAAAATGTT TAATTGACTC CCAGTCTGCA TGGCTGGAGA
402101 GGTCTCAGAA AACTTACAAT CATGGGGGAA GGCAAAGGAG AGGCAAGTAC
402151 CTTCTTCACA AGGTGGCAGG AAAAATGAGA GTGAAGTGAA GACGGAAGAG
402201 CCCCTTATGC AACCTTCAGA TCTCATGATA ACTCACTCAC CATCACAAGA
402251 ACAGCATGAG GGAAACCACC TCCATGATCC TATCACCTCC CACCAGGCCC
402301 CTACCTTGAC ACGTGGGGAT GATGGGGATT ACAGTTTGAG ATGAGATTTG
402351 GGTGAGGACA CGGAGCCAAA CCATATCACT CACCAATTAT TCTTTAAAAG
402401 TGTGATTCAC TCCATCACTT CCCTAGATTG CAAAATAAGC ATGGTGTTCC
402451 AAATATAATG GGTAACTAAT GATGAGAACT CGAATTATAG GTTAGAATGG
402501 ACCTCTGTCT AACTTTTGGC TTTTTCCATA TGGCCTTGAG CAAATGTTCC
402551 AGTTACTCAG TGCTACATAA AAAAACACCC CCAAATTTAA TGACTTAAGA
402601 CAACACTGAT CATCTATTTT GCTCACAAAT CTGTAATGTG AGCCAGGATT
402651 GGCAAGGGCA GCTCATCTCT GCCCCATGCA GCATCAGCTG GATTGGCAGG
402701 AGTGGGGACT GGAGGATCTA CATTCTAGAT GGGTCCCTCA CTTGTCCGGC
402751 AAATTGGTGC TGGTTTTCAA CCACGAGCTC AGCCAGAGCT ATGAGCAAAG
402801 AACCTAAATT CTCCGCGTGG CCATCTCCAT GGCTGCTTGG TCTTCCTCCT
402851 GCCACATGGG TAGTTTCTAA AAGTAAGCAT CCTGAAGAAT CAGACGAAAG
402901 CTCTATTACC TTTTATGACC TAGCCTAGGA AATCATATAA AGTCACTTCT
402951 ACTATAGTCA CAAGCACACT GATTTCAAGA GAAGAGAACG GAGGCCTAAC
403001 AGTTTTGTGC AATGAGTGTC TATAAGAAAT TGTCAAAAGA ACATATGTTT
403051 TGAAAAAATAT TGTTGGGGCA TTTTTTTGGA AAACAATCTG CCACAGTACA
403101 TTATTTAATA TTACTTAGCT TCAGGTTCCT CATCTTAATA ATAAAATGGT
403151 AGACACCCTT CTGATCATTT TATACATATG ACATTTATTA ATCCCTCACA
403201 ACCACCCCTG AGTTAAGTTC TATCTTTTAT TCCCATTGTC TTAGTCAGTT
403251 TGGGCTTCTG TAACAAAATA TCATAGACTG TGTGGCTTAA ACAGCAGAGA
403301 TGTTTTTCTC ACAGTTCATA AGGCTGAAAG TCCAAGATCA AGGCACCAGA
403351 AGATCTGGTG TCTGGTGAGT ACCCTCTTCC TTATTTGCAG ATGGCTATCT
403401 TCTGCTGTCC TCACATGTAA GAGGGCAGAG AGGTCTGGTT TCTTCATTCC
403451 CTTATAAGGG CACTAATCCC ATTTAGACTT CCATCCTCAT GAGCTAATCA
403501 CTTCCCAAAG TCCCCATCTT CAAATATGAT TGCATTGGGG ATTTCAGGCT
403551 TCAACATCAA AATTTGGGGG GCATACACAC ACTCAGTCAA TAACACCTAT
403601 TCTACAGAAG TGAAAACTGA TGCACATGAA AATAAGTCGC CTTAAATGAC
403651 AGAGCGAGTA AACTAAAGAA ACAGAACTCA AACCCATGTG ATCTAGTTTC
403701 AAAGGCCACA TTCTTTATTT ACTTTGTAGT TAATTTTTGT AAGAATAACC
403751 AAAATATTAT ATGCAAAGTG CTTATCAAAG TGCCTGGCTC ATTCTGAATG
403801 TTCAATAATT ATAAATGGTT TTGTTGTAGT TATTATTACT AATATATCTT
403851 ATAGTAAGTT ACTGGATGTA TTCTTTTTGA AGACATTTTT CTTTATCCAT
403901 AAAAGCAAAT TCAGTCTGAC TTAAAGAGTA TGCAATAAAG AAATATTGAA
403951 AGAAAAGATG ACAAACTGTC ATAACTAGAT GGTCTACACA AAATAGTGAA
404001 ACAAGAATAA GAATCTCTGA CTAGGGGATA AAAATACTAA ATAGTATTTC
404051 ATTTCAGGAT ACTTGGGAAT CTGATTATAG ATTCACTGAG CACATTTTTT
404101 AAAACCAAAT ATGAAGAAAG TAATATTAAT GTGGGATTAA GTATGGTTGA
404151 CTAAAACATA TCTGGGAATA TAACATTAAG TAAAAATCAT GTTAGAAGAT
404201 AAATGTTGGA ACATTTAAAG GGTGATCAAT ATTTATAGAA ACAACATAGT
404251 AGCTTCTATG TTGTATGAGT ATTATTACCA GATTATATTC AAAATGGTAA
404301 TAAAAATTTA GCCTAATCCT AAAAACTGTT GATGTAAGTC TTTTGGTCTA
404351 CATACCTTAT CTTAACTTCC AGAACAGAAA TGCTTACCTT ATTCTCACAC
404401 TAGAAACAGC TTTAGAATTT TAACTTTGCT TGTCACTACC CTCAGACTAC
404451 TAAACTGTTT CTGACTCTTT TCCAAATAAT GCTGTAACCT TGACACTTGT
404501 CCATCCCTTG AGTGTATGTG CTTTTTTTCA AATCATCTTT AACATATAAA
404551 TTATAAATCT ATGAATGAGA AAAGATGATA AAAGATAAAT TGAAATATAA

FIGURE 3OOOOO

404601 TACATTCACT TTATGCTTAT TAATGGCAAC TTACCTGAGT TTGCCAGTAT
404651 GGAAATATAT ATTCATTTCA GGATATTCAG GAATATGGTG TTAGTTTTCC
404701 TGTGTGTGTG TATATAACCC CTGTTTCTAA GTTCATGTGT CAAAATAGCC
404751 ACATCAAGAA ACAAACTAAC TGAAAACAAC AGTATATGAT TTCTATGTTG
404801 ATGTCCTCTT CTCTACATAA CCAGAAGTTT AAAAACCGGA CTGCTTGTCT
404851 GATACCTGGG TGCTGGTCTT GGCCTAGTTC TTAAGTCTTT GGCATGTTAA
404901 ATAGAATAGA ATCCACATGT GTGCATTTGG GAGTAAGCCC AAGAGTTCAT
404951 AAACAAGTTT ATGGATTGCT TTTCTAAGCT TCTCTGTCTC TCCATGTTCT
405001 CCGGGTAGTT TCTGGTTTCC TGTGGTTTCT CTTTAAGATC CCTTGGCAAG
405051 AAGGCTGAGG CTTTATTTCC TCCACTGTGC TGTGCCCTTC TGCAACTACA
405101 TTCACTTCCA GGGCCATGTG AGAGGAGGAC AGAGAGAAAA AGAAACATAA
405151 TGGAGGTTGA CCCAACCCTC TTGGAACCAC AGCTTCAGTG AACAAACAAG
405201 AAAATTTACT TTCTTAAGAA TTTCGGCTCC TGTGTTTCCC ATTTCTGGCC
405251 ACCACCACCA CCATCACCAT GTGATTGCTT GAGGACTGGG CAAGAGTTAA
405301 GCAAGAAAAG AAAAAACGGG TGGGGAATTG CCACATTCTC TCTGAGCATT
405351 ATGAGTTCTG ATTCCCACTC CTAAAGCTAA AATGAGCAGG CTTGTCCTGG
405401 AGCTGTCTAT GGCCTGGTGT CCACTTCCAA GTTTCCAGTT CATTCAGGGC
405451 AGGAGAGGGT TGAGTGGGAA TTAGAAAGAT GAATGAGAAC AATGGTAAAC
405501 TTATCATCAG CCCAGCGATA CTTCACATTT TGTCTTCTCC AATGTGCCTA
405551 CTTCTACTTT GAGTCCTCAA ATTGCTGCTT TGTGTATTCT TCCTAGATTT
405601 TACAGTTAAG CGGGAGAAAG AGGATGCCAT GTGCTTACTC TATCCTTTCT
405651 GGAACAAGAG CATTTTACTC TTATTCTTTG GGATGATATT GATGTAACTT
405701 GCAGTATATT TATGTAGGTC TAATGGTTTT TCTATTTGTT TATTCAACGG
405751 GAAGTTCATT AAAGCATTTT TCTGATGACA GTAAGAAATT GGAATTAGTA
405801 CCAGTACTCC TTTACATACA TTATCTAATC ATAATCTCAT GTGTTCTGTG
405851 TGTGTGTGTG TGTGTGTGTG TGTGTGTGTG TGTGTGAGAG AGAGAGAGAG
405901 AGGGAGAGGG AGTCTCATTC TGTTGCCCAG GCTGGAGTGC AGTGGTGCAA
405951 TCTCAGCTCA CTGCAACCTC CGCCTCCCAG GTTCAAGTGA TTCTCATGCC
406001 TCAGCCTCCC AAGGAGCTGG AATTCCAGGT GCCTGCCACC ATGCCTGGCT
406051 AATTTTTGTA TTTTGAGTAG AGACAGGGAT TCACCATGTT GGCCAGGCTG
406101 GTCTCAAACT CCAGACCACA AGTGATTCAC CCACCTTAGC TTCCTAAAGT
406151 GATAGGGATT ACAGTCTTGA GCCACCTCAC CTGGCTTCAT GTATTCTTTA
406201 CAGTAGCCAT CCTCTGAAGA AAGTTGGATT GAATATTTTG AAGCACAATA
406251 CTATTGCTAT ACGCCCAACA GAAAAGCGTG GAGTGCCACT GCACTCCAGC
406301 CTAGGCAACA AGAGCGAAAC TTTGTCTCAA AAAAAAAAAA AAAAAAGAAA
406351 AGAAAATTAG TGGTATTTCA ATCACTGTAT TCATATTTAG TTTGCCTTTA
406401 ATATATATCT TTCTCTAAAA ATTTACTTTG ATTTTTGCCA TATGTATAAT
406451 ATTTTCATTG TTATTTTAAG CAATCACATA AAGTTTCTCA AATTATAAGC
406501 GTATTTTGAA ATAAAAATTT CAAAACATAT TTCAGAAATG AGGATATGTT
406551 TGTAATTTGA TTATTCTTAA CTGAATATAC AAGCTTATTA TTTATAGACT
406601 TGGATTTGGT GAATTTGAGA ATTTCACTGG ATGCTATGAG GTTATTCAGA
406651 AGAAACAACA TATGTGTGTT TATTCACCCT TAAGTTTTGC AGTTTTCTTA
406701 TGTTTAAATT CCTTAATCTT CTCTGCTTTT GCTAGTAACT TGACAACAAT
406751 ATTTATTGTA CAGCAGCATC TAGAAAACAT AAATGATACT GTTTTTGCCA
406801 GTTTCTTAAA GTTCTTTCAA GAATGCTATT ATTTTGAGAA ATGATGCAGA
406851 TCATATATTT TACTGATAAG TCATGCAGGT TTATCTAAAC TTACAGGCTA
406901 TTGAACACCA TGAGGGAAAA GCAGTCGATT ATATTAATAT CAGTTCCTGA
406951 CACACAAGAC GCAATTCAAT ATTTAATCAA ACAATGAGAA CCACACAGCA
407001 TGATATGCTA GCTAGGATTT CTCATGTTAT TTTTTTGTCT TCCAGTTCTC
407051 TGATAATAAG GATAAGCCTA AAAACACTGC TAACAATATA TAGTCTAACC
407101 ACTCAATTTT GAAAGTATGA GTAGAACAGA TTATTCATTT CTTATTTTTT
407151 GTTTTATTAG AGACATACTT TGTGTGTGTG TGTATGTGAC TGAAAGTCAC
407201 AGGCTTCAGC TGTGTTTCAA TCAATACTTC AATATTCTGA TTTCAATTTT
407251 CTGTGGATAA TGAAATTTCA AACATCTATA AGAGAAATTG TTGTATAAGA
407301 TAATTAGTGT AGCCAGGCAT CATGGCAGGC ATCTGTAATT CCAGCTACTC
407351 AGGAGGCTGA GGCAGGAGAA TTGCTTGAAC CCGGGAGGCG GAGGTTGCAG
407401 TGAGCTGAGA TCATGTCACT GCACTTCAGT CTGGGCAACA AGAGCAAACT
407451 TTGTCTCAAA AAAAAAAAAA AATAGAAAAT TAGTGATATT TCAATCACTG
407501 TATCCATATT TAGTTTGCCT TTAATATATG TCTTCTCTAA AAATTGACTT
407551 TTGCCATATG TATGACATTT TCATTGTTAT TTTAAGCAAT CATGTAAAGT
407601 TTCTGAAATT ATAAACATAT TTTGAAATAA AAATTTCAAA ACATATTTCA
407651 GAAATAAGGA TATGTTTGTA ATTTGATTAT TCTTAACTGA ATATACTTCC
407701 TCCAATTATA TGATCTGAAA TTTAGGAAGG TAAAAGCTTT TTGTTAAACA
407751 TAGTTTATTG AACATATTAG TTTACCTGTA TGCCTTTTTG ACAATTCACT
407801 AACAGGAATA AGGGTATATG GAATGTTTAC TCTAACAAGA AGAAAGCAAA
407851 AGAGAAAGGG AAAAGAAACT ACATCAGGTG AGAAAAGTCA ATGTCTGTAT
407901 TAGGTCATTT CTTTATTGCT ATAAAGAAGT ACCTGAGATG GGTAATTTCT
407951 AAAGAAAAGA GTTTTAATTG GCTCATGATT CTTCTGGCAG TACAAGCATG

FIGURE 3PPPPP

408001 GCTCCAGCAT CTGCTTCTGG TGAGGGGCTC AGGAAGCTTC TAATTATGGT
408051 AGAAGGAGAA GCGGAGCCTG TACATCACAT GGTGTGAGCA GGAGCAAGGG
408101 GTGGGGAGGT TGTGGTCCTA GACTTTTAAA CAACCTTATC TCGCATGAAC
408151 TAACTGAGCA AGAACTCACT TATAAACAGG GGATGCTTCT AAACCATTCA
408201 TGAGGAATCC ACCTCCATGA TCCCGTCATC TCCCACCAGG CCCCACCTCC
408251 AACATTGAGA ATCACATTTC AACATGAGAT TTCAAGAAGA CAAATATCCA
408301 AACCACATCA ATGTCAACAA ATTTCAGAAA ATGAAAATCA AGTGGAGGAT
408351 CAATAACTCA TGTAGCAATG GAAATTAGTA TGACTACTTC AGGGGGATAG
408401 GCCCCTTTCA TCTCATGCTT TTCTTTTGGG CATATAGCAA GCAGTGGAAT
408451 TGTTATATCA AATGGTAGGC CTATGTTCCT ACCTATAGTA AGTACTGCCA
408501 AACAGTTCTC TAAAGTGGTA GCACGAACTT AAACTCCTCC AGTGATATTT
408551 TAGAGTTCGT ATTGCTCCAT ATTCTCAGAA ACATTTGGTA TTGTGTGTTT
408601 ATTTCATCTA AGTATTCTGG TACAGGTGGT AGTATTACAC TGCACTTTAA
408651 AATAAGTTAT TTAAATATGT ATTTGAGAAA CTAGATATAG TAGATAGGAA
408701 AAGGACATTA TAGAAGACAA TGAAATATGA AGACAAAAAT AAGAATTTAG
408751 GATGACTCAA GCAGTCTGAT TTTTACTTTT GGTCAAGATG GAGTAACTTC
408801 TACTATCTGA GATAAGAAAA CTCATTTAAA ATATGTGGAA AAAAACATAT
408851 TTAAGACATG AGACATCAGA TAACCAAGAG ATAGTAATTA AAAGAGGAAA
408901 GCCCTACAAT TTCCCCAACT TACTATTTAG GGTAAATTTT TAGGCCCTGG
408951 CACAGGAGAA AGGACCCTGA TAAAACCTTA TAAACTCCTT AATGCACTAT
409001 TAATCGAGAA GACAGATCTG AGAGTTCAGG GAAATCAAGG TAGCAAGATT
409051 TCACAATGTC AGTATGACAG AGAAAAGGGC TTTCCAAAAG ACAACTCCAG
409101 AGAGGTGCAG AGGTTCTCTG TGAGTGCTCA CTTAAATTTT ACTAATAAAA
409151 AAAATTCAAC AAAGAAGATA AAACAGATGG TAAAAAGTAT GTCACTTTTC
409201 TAAAAGAACA TAGGAAAAGA GGAAAATAAC AAAGACATGG GACAAATGCA
409251 AAGCAAATAG CAAGGTAGAA TTAAACCTAA GAATATCAAT AATCACATTA
409301 AATATAAATG ATCTAAATAC CCCAATTAAA TGGCATAGAT TGTCAAATAG
409351 TAGTTTTTTA CAAGACCGAG GTATGTGCTG CTTCCAAGAA ACATACTTTA
409401 AATATAAAAA TGAAAATACC CTAAAATGAA GAGGTATAAG AAAACTTCTG
409451 GGATTGACAG ATATATTCGC TATCTTGATT GTGCCAAGTT TTCACAGTTG
409501 TGTAGATATA TCACAATATC CAATCATATG CTTTATTTGA AGTTTTGTGT
409551 ATGCCAATTA TACTTCAGTA AAACTGTGAG AAAATAATAT GGTCCATGTA
409601 GGGAGTGGCA AGAAGTATAA AATTTCTGTA GCAGTGGAAG GTGATTTTGG
409651 AAAAATAGAT GTGAGTCCAT CTCTGAAGGA AATTAAATGC TAATCTTAGT
409701 TTGGACTTTA TTCTAGAAAC CAGGTATTGT CATATTTTTT TCTGTGAAAA
409751 GCCATAGAGT ATGTACTTTA GACTTTGAAG TCTGAGTCAA AAATCTAGAA
409801 TATCATATAC TTATATAATC ATTTAAAAAT ATAAAGGCTG GGTGCAGATG
409851 CTTATGCCTG TAGTCTCAGC ACTTTGGCAG ACCGAGGCAA GGCAGATCAC
409901 TGAAGCACAG AAGAATGGGA CCAGCCTGAA CAATATGGCA AAACCCCCTC
409951 TCTACAAAAA ATACAAAAAT TAGCTGGCAT GGTGGTGCAT GCCTGTAGTC
410001 CCAGCTACTT GGAAGGCTGA TGTGGGAGGA CCACCTGAGC TTGGGATGTG
410051 GAGGCTGCAG TAAGCTGTGA TCATGCCACT GCACTCTAGC CTGGATGAAA
410101 GAGTGAGACC CTATCTTAAA AAAAAAAAAT GTAAAACCAT TCTTAGCTCT
410151 CAGTCTGTGT ATTAGTCCAT TTTCATAGTG CTATAAAGAA CTGCCTGAGA
410201 CAAGGTAATT TATAAAAAAT AGAGGTTTAA TTCACTCACA ATTCAGCATG
410251 GCTGGGGAAG CCTTAGGAAA CTTACAATTG TGGCGGAAGG CAAAAGGGAA
410301 GCAAGGCACC TTTTTCACAA GACAGGAGGA AGGAGAAGTA CCTAGCAAAG
410351 TAGGAAGAGC CCCTTATAAA ACTATCAGAT CTTGTAAGAA GTCACTCACT
410401 ATCATGAGAA TAGCATCAGG GAAACCACCC CCATGATTCA ATTACCTCCA
410451 CCTGGTCTCT CCCTTGACAC ATAGGGATTA TAGGGATTAT AATTCAAGAT
410501 GAGACTTGGT TGGGGATAAA AAGCCTAACC AAATCATTCT GTCCCTGGCC
410551 CCACCCAAAT ATCATATCCT TTTCACATTA TGATACCAAT CATGCCTTCC
410601 CAACTGTCCC CCAAAGTTGT AATTCATTCC AGCATTAACC CAAAATTCCA
410651 AGTCCAAAGT CTCATCTGAG AAAAGGCAAG TCCCTTCAAC CTATGCACCT
410701 GTAAAATCAA AAGCAAGTGA ATTAGTTTCT AGATACAATA GGGGTACAGG
410751 CATTGGGTAA ATACACCCAT TCCAAATGGG AGAAATTGAC CAGAACAAAA
410801 GGGCTCCAGG CCTCCTGTAA GTCTGAAATC TAGTGTGGCA GTCAAATCTT
410851 CAAGCTGCAG AATGATCTCC TTTGACTTCT TGTCTCACTT TCAGGTCACC
410901 CTGATGCAAG AGGTGGGCTC CCACAGTCTT GGACAGATCT ACCCCTGTGG
410951 CTTTGCAGGG TACAGCTCCA CTCCTGGCTG CTTTTATGGG CTGGCATTGA
411001 GTGTCTGTGG CTTTTCCAGG CACATGGTGC AGGCTGTCAG TGGTCTACCA
411051 TTCTGGGGTT TAGTGGATGG TGGCCCTCTT CTCATAGCAC CACTAGGCAG
411101 TACCCAAGTG GGGACTCTGT GTTGGGGCTT AAACCCTACA TTTTCCCTCT
411151 TCATTGCTCT AGTAGAGGTT CTCCATGAGG GCTCCACCCC TGCATCAGAC
411201 TTCTGCCATA TAATGAAATA TTATAATAAA TGTTAATCCA GGCATTTCCA
411251 TACATCCTCT GAAATCTACG TAGAAGCTCC CAAGCCTCAG TTCTTGTCTT
411301 CTGTGCACCT GAAGGCCCAA CAGCACATGG AAGCTGCCAA CGCTTGGGGA
411351 TTGCAACCTC TGAAGCAATA GCCCAAGCTG TACCTTGGCC CCTTTTAGCC

FIGURE 3QQQQQ

411401 ATGGCTGAAG CTGGAGTGAC TGGGGTGCAG GGTGCCATGT CACAGGGCTG
411451 CACAGAGCAG CTGGGCCCTG GGCCCAGCCC ACGAAACCTT TTTTCCCTCC
411501 TAGGCCTCCA GACTTGTGAT GGGAAGTGCT GCCGTGAATA TCTCTGAAAT
411551 GCCCCAGAAA TATTTTCTCC ATTGTCTTGG CAATTAACAT TCAGCTCCTT
411601 GTTAGTTATG CAAATTCCTG CAGCCAGCTT TAATTTCTCC CCAGAAAATG
411651 GGTTTTTCTT TTCTATTGTA TCATCAGGTT GCAAATTTTC CAAAATTTTA
411701 TGCTCTACTT CCCTTTTAAA CGTAAGTTCT AATTTCAAAC CATCTCTTTG
411751 TGAATGTATA AAACTGAATG CTTTTAAGAG CACCCAAGTA ACATCTTGAA
411801 TGCTTTGCTG CTTAGAAATT TCTTCTGCCA GATACCCTAA ATCATCTCTC
411851 ATGAGTTCAA GGTTCCACAG ATCTCTAGGA CAGGAGCAAA ATGCTACCAG
411901 TCTCTTTGCT AAAGCATAGC AAGAGTCACC TTTATTCCAG TGCACAACAA
411951 GCTCCTCATC TCCATCTGAG CCCACCTCAG CCTTGACTTA ATTGTCCGTA
412001 TCACTATCAG CATTTTGGTC TGAGTCATTC AACAAACTTC TAGGAAGTTC
412051 CAAACTTTCC CACATCTTCC TGTCTTCTTC TGAGCCCTCC AGGTCTCTAG
412101 AAAGTTCCAA ACTTTCCCAC ATCTTCCTGT CTTCTTCTGA GCCCTCCAAA
412151 CTGTTCCAAC TTTTGCCTGT TACCCATTTC CAAAGACGCT TCCACACTTT
412201 TGGTATCTTT ATAACAGTAC CCCACTCTCT TTGGTACCAA TTTACTGTAT
412251 TATTCAATTT TCATACTACT ATAAAGAACT GCCCAAGATT GGGTAATTTA
412301 TAAAGGAAAG AGGTTTAATT GACCACCAGT TTAACATGTC TGGAGAAGCC
412351 TCAGGAAATT TACAATCATG GCAGAAGGCA AAGGGGAAGC AAGGGACCTT
412401 CTTCACAAGG CAAGAGGAAG GAGAATTGCC TAGAGAAGGG GGAAGAGCCT
412451 CTTATAAAAC CATCTGATCT TGTGAGAACT CACTCAATAT CACAAGGACA
412501 GCATGGGGGA AACCACCCCC ATGATTCAAT TATATCCACG TGGTCTCTCC
412551 CTTGACACAT GGGGATTATG AGGATTATAA TTCAAGATGA GATTTGGGTG
412601 GGGACACAAA GCCTAACCAA ATCAGTCTGT ACAAATCTGT GCAGTGGTCT
412651 GGTTTTGCAA AAAGGCTAAA CTCTTACAAT AGACAATAGA GAATAGCATA
412701 GCCATATCTA CTATTTAGAA ATGTAACTTG CAGAAACTGT GGAGTGGATA
412751 TGAGCAGGGA GAAAGCAGAG AAAGGCAGAC CTGAGATGAA TGCACTATTC
412801 CAAAAGATGT AGTGATTTAA ATAATAAATC TTTATTATTA TGGGGGAAAA
412851 CTTAAAAGTA GAAATTAAAA AGGTAATGCA GGCTGGGTGC AGTGGCTCAT
412901 GCCTATAATC CCAGCACTTT GGGAGGCCAA GGCAGGCGGA TCACAAAAGT
412951 CAGGAGCTGG AGCCCATTTG GCCAACCCGG TGAACCCTCG ACTTTACTAA
413001 AAATGCAGAA ATTAGATGGG CATGGTGGTG CATGCCTGAG AACCCAACTC
413051 GGGAGGCTGA GACAGGAGAA TCGCTTGAAC CAGGGAGTTG AAGGTTGTGG
413101 TGAGCCGAGA TCCTGCCACT GCACTCCAGC CTGGTGACAG AGCAAGACTC
413151 TGTCTCAAAA AAAAAAAAAA AAAAAAAAAA AAAAAGGAAA GTAACGATGG
413201 TCTATTCCCA AATAGATTTT TCTAAAGGAA AAAATAATAG AAACCACTTT
413251 GTTAGATAAC CTGTAACTTT CCTACATGAT TCTGTAGAAT ATAGACATAT
413301 GTTGGACAAC ATTCTTATCT CCACTCGCTT GTTTCTTGAA AGCAAGAAGT
413351 TTATACATCC TATAATATAA ACAGAAAAAT AAGGAAGTAG TAGAGAAGGA
413401 AAGAATATAT AAGAAAGAAA TTTAAAAGTT CTCAAGACAT GAGTACTGAT
413451 ACCCCATTTA TAACCCAATT CTAACAAAAC CTAAGACCAC TAATTGAATA
413501 GATACACAGA ATACTTGTGC AATTATCTCA TGTTCGGTAT TAGCATTCAC
413551 CATTTATTTA CCATCATTCC ATTTTTACAG TGTTTATAAA AACTAAAGGC
413601 TGGGTGCGGT GGCTCATGCC TGTAATCCCA GCACTTTGGG AGGCCGACGC
413651 AGGTGGATCA CTTGAGGTCA GGAGTTCAAG ACCAGCCTGC CAACATGGTG
413701 AAACCCGATC TCTACTGAAA TACAAAAATT AGGCAGATAT GGTGGTGGGT
413751 GCCTATAATC CCAGCTAGTC AGGAGGCTGA GGCAGGAGAA TTGCTTGATC
413801 TGGGTGCAGA AGTTTCAGTG AGCCGAGATC GCACCACTGC ACTCCAGCCT
413851 GGACAACAGA GCCAGACCCC TTCTCAAAAA AAAAAAAAAA CCAACCAACA
413901 AACAAAAACC CTAAAACCTA AATATGCCTG AAATACGGTA GATATTGTGC
413951 ATACTGTGAT ATGTGATATT GAGGCCCATC TCTGGCTTGT GGCAGTTACA
414001 TAAAGCTGAG ATAACACTCG ACACAATAGT TGTAATCTAA TATGATATGA
414051 TCTGAGAGTT ATATGCTGTA TACTATTAAT GTGTGCTATA TAAGAGAATG
414101 TGAGTGCCTC AATAATAATT TTCTAACAAC AGAATTCTTT ATTTTTAAAT
414151 GAAATATTAT ACTAAATGTT AATATTGAAA TAGAGAAATA TTGAAGTAAC
414201 CCAAATATAT TTTATGGGTT CAAAATTTTT AGGATTTCAA AGGCAAGTTG
414251 ATGTACAAAA ACATTTGAAA TCAGGGATAG TTGAAAGTTG CAGCTCCTAT
414301 ATCCAATTTA TATATGTATT TTTTGCATTA GGAGTAATAT CCAAGTTCAC
414351 ATTAATAATA ATTTCAAATG GAAACTTGTT AATAACTAGG TCATCTTGCA
414401 ATATTAGAAT AATCATTTTT CAGACACAGT TAAATCACTT TCAAGATATT
414451 TACTATCTGT TTTCATCCCT AACCTATAAC ACATTAAGCA GAAAACATAT
414501 AAATCTATAG AAAGATGAAT TGTGCCATTA CCAGACCATG CATTAAGTAG
414551 ATATGCATAA TCTTCTACAG GAATTTAATT AGCAGAGTAC TCACACACTA
414601 TCCAGTTCAA TTAAACAAGT ATGTATCGAG CACCTACATT ATAACAAGCA
414651 CTAAGCACCG GACAAATCTG CTCTTGTGGT GCTTACAGCC ATTAAACAGG
414701 TAATTACCAA GGCTAACTAA TGCGGAAAAG GCCCAGGTCC TTTGAGAAAC
414751 TAAATTTGGC CTAAGAAGTC AGAATGGCCC TCTTAAAGAA GTGCGAGCTG

FIGURE 3RRRRR

414801 AAAGATAAGT GAATCACAGA GTCATCGGGG TTATAAGGAA TTGGCAACAT
414851 ACGTGGGTCA TGAGGTAGAG ATACAGTGAA TAGACTTTTC AACAGAGAAG
414901 AAGCCTTAAA GCAGGAGAAA GAGCATGGTA AAACCATAGA AATTAAAGGA
414951 GATCTTTGGC AATTCATTCC TTTATTTGCC AAATATACCT CATTTGAGGG
415001 TCTAATAATG CCTAGCACTG TTCTAGACCC TGGAAATGCA TTTTAGAAAA
415051 CAAAACAAAG AAAAATATCT CCCTTATTGG AGCATACATT TTACTGTGGA
415101 ATGATTTAAA AATTAAATGC ATCATGTATC AGATGTGAAG TTCTTTGGAG
415151 TGGGGAGCAT AATATGAAAT ATTGCAGCAG GGTGTAGCAG GAAGCAGGGA
415201 AGGCTTCATT AATTTGGTGA CATTTGAACA AAGACCTGAT ATAAAGGAAG
415251 GGTTAAAGCA TGCAGATAGC TGAGTAAGAG CAAGTGTTAA AAAAAGCCCT
415301 GTTGTGGGAA CAAGCTTGGG TGTCCAAGAT TCTGGAAAAG GCCAGTGTGG
415351 CTAGAGCGAA GTATCTGAAG GAACAAAAGG TAGGAAATGA AAAGCAGAGT
415401 CACTGGGGGT GGGGAGCAAA ACCATGCGGT GCTTGGGAGG CAGTTATCAA
415451 GGCAACAGCT TCTACTCTCC GAGGAAGAGA AAGCCAATGG AAGGCTCTAA
415501 GTCCAGTCAT AATACAGTCT TATACATGTT TTAAGGAGAT CATCAGCTAC
415551 TGGGTTGACC ATAAATTGGA GAAGGGCAAA GCCTTAACGG AGAAGGTGCA
415601 AGAAGGGAGT ATCTTCATCT GATGTGGTTG GAGAGGTAGG CAGGGCCAAA
415651 TCATGGGCAA CGTTGTAATC CAAGTTAAAT ATTTTAAACT TTAACATTAA
415701 TATGGTCGGA AATTATAAAA AATTTTTGAA TAGAAGAATG TAATGAATAG
415751 ATTTCTGTGT TTAAAATTGT GCTATCCAGT ATGGTATTCA CTAGCCATGT
415801 GAGGTTATTG GGCACTTGAA ATGCAGTTAG TTTAAATTGA GATCTGCTAA
415851 AGTACATACA GGATTTCAAA TACTTCGAGA AAAAAAAAAT TTAAAATCCA
415901 AGGAATGTAA AATATTTCAA TGGTTGATTT AATGTTGAAA TGATAATATT
415951 TTGGATATAT TGGGTTAAAT AAAATATATT ATTAAAATAT AATTTCACCT
416001 GTTTCTTTTT AGTATTTTAA TGTGGCTACT ACAAAATTTA AAATTATTTA
416051 TATGTGTCTC ACTTTATATT GCTGTTAGAC ACAGTGTATT TAGAAGATCA
416101 CTCTGTCTGA AGAATGGATT AAAGTGGGCA AGAATAGTTG CTGAGAGGCT
416151 AGTTATGAGA CTGTTCTCAA GAACAGTTCG AATATCACTA GCCTATTCTA
416201 AATATCTTAG GGAGATGTTC TAAGCATTCT GAAAAGATTC TAAGAAGTGG
416251 GAAATTAACA GAAAACACGT CAGATAAGAA ATTATTTAAA TTCTTGTTTT
416301 AGCTACCAAA GAAAATAAGT AAAAGGTAAC AATGTCTTGC TGCACAGAAT
416351 TAAGTTATAA GCACGCTACT TTATATTCTG AACAATGTTT TTGGCTGAAA
416401 TTTGCATGGC TGATTAAAAG AAGAAAACAA TATGCTTATA ATTCTTCTTT
416451 ATGTGTCTTA TAGGTTCTAT ATATGTACAT GTAAAAATAT CTTTTATATT
416501 GTGGTTCTAT GGCATACATA TTCCTAATTA ATTTTAAACG GTCTTATTCT
416551 ACAGAATAAC ATAAAAAACC TTTTAAATAA TATTTAAAAT GTTTTAAATA
416601 TTACTTTATC TTAAAGTAAT ATTTTAAATA CCACTGCAAT ATTTAGAATG
416651 TAAGCTCCCC ATTTAGATTT ATATATTCTC TATAAATTGA CTAGTATGTT
416701 AGAATTTTAA ATATTGTTAT AGATTAAAGG TATTACTTCA ATTTCAGGTC
416751 CAACTTGTTA ATTTTTGACT GATTTTTTTT TTTGCTTTTT TGGGTTTTTT
416801 TGTTTGTTTG TTTGTTTGTT TTGAGACGGA GTCTCGCTCT GTCGCCCAGG
416851 CTGGAGTGCA GTGCCGCGAT CTCCGCTCAC TGCAAGCTCC GCCTCCCGGG
416901 TTCACGCCAT TCTCCTGCCT CAGTCTCCCG AGTAGCTGGG ACTACAGGCG
416951 CCCGCCACCA CGCCCAGCTG ATCTTTTGTA TTTTTAGTAG AGAGGGGGTT
417001 TCACCGTGTT AGCCAGAATG GTCTCAATCT CCTGACCCTG TGATCAGCCC
417051 GCCTCGGCCT CCCAAAGTGC TGGGATTACA GGCGTGAGCC ACCGCACCTG
417101 GCAATTTTGG GCTAATTATT AACAGACCTA TCCTGTCGAA TATATTCAGT
417151 TATTTTAAAC TGCATATTTT AGTAGAAAAC AATTATTTTA TTGGCAAACT
417201 GTATAAGGTA GATTTATTGA CTATTTTGTG ATACATTGTC ATAACTGCTG
417251 TCATAAGATC ACATTTAGTA ATTATTTTTA AACAATACTT CAATTATGAA
417301 AATGTTAGCA ATGTTTCTCA TATATTATTT ATGTATTCTG AATTTTCAAA
417351 ATTTTAGAAC AATATGTTAA TGATAACCTT TTTTGAGTGA CTATATACTA
417401 TTTATTTATT AATAAGTTAT TGAAGAGACT ATTGTATATT TGTGTACCAC
417451 CACTCCTCAT TGATGTTGAT ATTGAATAAC CAACCTCTTG ATAGTAATTT
417501 TACTGTGTGG AATTGGTAAT TTTGCTTCTT TTGAATTACT AGATCATTTA
417551 TAAAAATATT ATTATAAAAG CAAACATAAA CTATCAAAAA ATAGAGTTAC
417601 AGCATATACA AAAGAAAATT TAGCCACTAA GAAAGGTGTC AAAGACATAC
417651 TTTCACCAAA TTAGAATTTT CTTCTTGACT ACTCAGAAGA ACTGAAGGGA
417701 AAATAGAATG TAAATACATT TTGAACAGAA TGGTTTAATG TTATTTAATG
417751 CCTTCTCTGA GAACGACACA AAATCATTTT CCTTACTGCC AGTCATGGGC
417801 ATCCCCATTC TTAGGTAAGC ACTGATATTT TGTGTGCACG TGCCCGTGTG
417851 AGTGTGTGTG TGTGTATGTG TGTATGCTTG AGGTATAATT TTAAAAATTA
417901 GCAGCCTCAG CTAAAATATG ATTGCATTGT GGTTTTATTA ACTCTCAATA
417951 ACTAATTTCA TTTGTTAATC TTAATATAGA TGTCTTCTCT ATGTATGTGT
418001 AACACTGTAC TCTGAGATCC AATGTGAATA TAAATTAAAG TATGTTGTAC
418051 ATGTACAAAT AAAAGAATCC TAGCAATAAT AACTAAAAAA GTGTTTTTTT
418101 CTCTTTTTAC AGCTTGCAGA CCAGGATTCT ATAAAGCTTT TGCTGGGAAC
418151 ACAAAATGTT CTAAATGTCC TCCACACAGT TTAACATACA TGGAAGCAAC

FIGURE 3SSSSS

418201 TTCTGTCTGT CAGTGTGAAA AGGGTTATTT CCGAGCTGAA AAAGACCCAC
418251 CTTCTATGGC ATGTACCAGT AAGTCTATAC ATTTTGGATT TGGAAATTCT
418301 GTTTCCAACC CTTTTGGTCT TTTCATTCTA AATTTAAAAA ATAAGTAAAT
418351 GTACAAAATC TTGCATTATC AATGCCATTT GTCTGTGATA ACAGTCAAGG
418401 AAAAAGCTTC TCTCTCTTCT CAGCATAGTT GCTTTTCAAC TCTTTGTAAA
418451 GAATGGGTTT ACTCCTCAAA ATTCATTTGG ATTCATGATG TACAAATGCC
418501 AGCACTGGTT TGAGGCCCTA CAAGTTTTCC TTATCCATAA TCTGTCCTTA
418551 GGAAATTATA GCAGTTGAAG GCTGCATGAG AAGTTATGAA CAAAACTTCT
418601 GTTCTTTGCT TCAACCCTTG ACCATTTTAA AGCATATCAA TTTAGGACCA
418651 TATAGTTAAC GCGTGAGGGA GATTCCAGAG GAAACTTTAA AAGTCATTGT
418701 GTTATTGTTA TGTAGAAAAG TTCAAGTTCC CTTGACATTT ATCTTTAAAG
418751 GCAGGTATTT TTGAGTTTTT CCACATTTCA CCTCTTACTT TCTCTCCAAT
418801 ATTTTTGGTT AGAAGCAGTA GAATGTTAAA TCTAAATGTG AAGGTCATTT
418851 TAATGCATAC ACCAAGAATT TTAAATGAAT TGTATTCTTC TATTATTAAA
418901 ATATTGTAAA ATATCAGTAC ATTTAAAAAA TAAAAGTGAA TATATTAATA
418951 CATTGCTAAG TTATGCAAAA GTAAAATAAT CACCCCTTAG ATTTTTTTTA
419001 AAGTTTTGTT TAATATGTTA ACATAAAAAC AAAAAACACA ATATATAAAT
419051 TTAGAAAAAG GTAGAGGAGA CTTTTTTTTT TTTTTCGAGA CAGAGTTTTG
419101 CTCTTGTAGT CCAGGCTGGA GTGCAGTGGC ATGATCCCGG CTCACTGCAG
419151 CCTCCACCTC CCGGATTCAA GCGATTCTCC TGCCTCAGCT TCCTGAGTAG
419201 CTGGGACTAC AGGCATACAC CCCCACGCCC AGCTAATTTT CATATTTTTA
419251 GTAGAGATGG GGTTTCACCA TGTTGGCCAG GCTGGTCTCG AACTCCTGAC
419301 CTCAGGTGAT CCACCTGCTT TGGCCTCCCA GAGTGCTGCG ATTACAAGCA
419351 TGAGCCACCG CCCCTGGCCG AAACTATTTT TTATGAAGAG TTACAGCTTG
419401 CAAGGTGGCC ATCCTGCAGG CTGGGAAATA TAGCCTCTGA CCAAGACATG
419451 CACTTTGAGG GTGGTAAGAA TGACAGGGAT TTACGCTGAG TGAGGTGGTC
419501 AAAGACACAT ATTAAATAAC GCTATAGGAG TCATGAAATT TATGAAAGCA
419551 GAAACATGCA CATGGGCAAT TGAGCTTCAT GCCTCAGCAT GGGACCCATG
419601 TACAAAAAAA TGGCCATGTT AGCACAACCC AAGGGTGGAG TTTTCAGCCC
419651 TCTGATGTCA AAAGGTGAAG CAGAGGACGT AGAAACCCTC ACTGAGCATA
419701 CTCTGGACTG GCCAGAACTA CTCCGTGGTT GGTGGTCTCT TATCAGGAAG
419751 GAAGCTGGTT AGTTGTTATG TCTAAACCAC AGAAAGGGAG GGGCAGCATC
419801 AGATAGTTGA TATCAGCGGT GGAGTGGGTC TTTAAAAAGG GCTGGCTTCT
419851 CTTTAACCCT TGAAGAAGGA AGCTTAATGG TAGTAAAGGA GGGAGGTGTG
419901 TCCAGCCTCT CATCTCATCA TCATAGTCGG GATCCCAGTT TTAAGGTTTC
419951 TCTGGGGTAA GCTTGGCCAT GAGGGGGTCT GTTCAATAGG TTGTGGAATT
420001 CGGATTTTAT TTAATTTTTA TTTTTATAAC AATAGTTTTT GGGGAACAGG
420051 TGGTGTTTGG TTGCATGGGG GAAGTTCTTT TGTGGTGATT TCTGAGATTT
420101 TGGTGCACCC ATCACTCGAG CAGTGTACAC TGTACTCAAT GTGTAGTCTT
420151 TTATCACTCA CTACCCTCCC ATCCTTCCCC ACTGAGTTCC CAAATTCCAT
420201 TATATCATTC TTATGTTGTT GCTCCTCATA CCTTAGCCAC CAGTTATGTG
420251 AGAACATATG ATGTTTGGTT TGCCATTCCT GAATTACTTC ACTTAGAATA
420301 ATGGTCTCCA ACTCCAGGTT GCTGCAAATA CCATTATTTT GTTCCTTTTT
420351 ATTGCTGAGT AGCATTCTAT GGTGTGTGTG TGTGTGTGTA TATATATATA
420401 TATATAATGT AAATGTCATA TAAATGTTAT ATATATATAT ATGTCACATT
420451 TTCTTTATCC ACTTATTAGC TGATGGGCAT TTGGACTGGT TCAACATTTT
420501 TTTGCAATTG CAAATTGTGC TCCTATAAAC ATGCATGCGC AAGTGTCAAA
420551 TAATGACATC TTTTCCTCTG GGTAGATAGA TACCTAGTAG GGGGGATTGC
420601 TGGATCAAAT GATAGTTCTC CTTTTAGTTC TTTAAGGAAT CTCCATACCG
420651 TTATCCGTGG TAGTTGTACT GGTTTACATT CCCACCAGCA GTGTAAGTGT
420701 TTGCTTTTCA CCACATCCAC ATCAACATTT ATGATTGTTT GATTTCTTAA
420751 TTATGGCCAT TCTTGCAGGA GTAAGGTGGT ATCGCATTGT GGTTTTGATT
420801 TGCATTTCCC TTGATAATTA GTGATGTTGA GCATTTTTTC ATATGTCTGT
420851 TGGCAGTTTG TGTATCTTCT TTTGAGAATT GTCTATCCAT GTCCTTTGCC
420901 AACTTTTTGA TGGGATTATT TGGTTTTTTT TCTTGCTGAT TTGTTTGAGT
420951 TCCTTGCAGA TTGAGTTCCT TTGTTGGATG CATAGTTTGC AAATATTTCC
421001 TCCTGCTCTG TGGGTTGTCC ATTAACTCTG CTGATTATTT CTTTTGCTGT
421051 GTGAAAGCTT TTTAGTTTAA TTAGGTCTTA TCTATTTGTC TTTGGTTTTC
421101 ATTGCATTTG CTTTTGGGTT CTTGGTCATA AACTCTTTGC ATAAGCCAAT
421151 GTCGAGAAGA ATTTTTCTGA TGTTATCTTC TAGAATTTTT ATGGTTTCAG
421201 AACTTAGATT TAAGTCTTTG ATCTATATTG ATTTGATTTT TGTATCAGGT
421251 GAGAGATGAG GATCCTGTCT CATTCTTCTA CGTGTGGCTT GCCAATTGTC
421301 CCAGCACCAT TTATTGAATA GGGTGTCCTT TCTCCACTTT ATGTTTTTGT
421351 TTGCTTTTAT TTTTATTTAT CAGTTACATA AGTCAGATAT TAAGGTGAAC
421401 ATTTGCCCTT CCTGGTGATG AATTGGTACC AAAATTTTGC TTATTTTATT
421451 TACTTCCATA GCAAGCAAAA CTAGACTTAT GTAATGTCAC ATATTTCTTA
421501 GAGGCATTTC TTAGAGATGT CCCAATTTTT TAAACTTAAC TAATGCAGTT
421551 CATAGATTTG TCTGTATTAC TATAGATCTT CCTTATAAAA TATTTCTATG

FIGURE 3TTTTT

421601 GAACACATTT AATAAAAATG TAATACATTC ATTGTTGCTA TTCATTAGTA
421651 GATGTAATTT TGGCTTTCTG ATTGTAAATG CTAAGTGACT GCTTTCTTCA
421701 GAAAATTACA GCCTAGAAAA TTACTACTTA GGTATTTTTT TTCCTGTGAA
421751 CATATTTTAA ATTTATAAAT AGCAAAATAA AACTTCTTAA TATAATTTCT
421801 CACTTATGGA AAAAAGTTTT TAGCAGACAA ATCTTCCTAT TACTATACAT
421851 GCAATCTTTC TTGCATGGTT ACTGAATAGT ATTATATATA GTATGGACAA
421901 CATACTACAG TTTAGGTAGT TTGTGATATT TCAAATAGTT ACAGACCTGT
421951 CAGGCATGTA TCCCTCAAAA CCTATGTAGG AAACTGAATG GAGCTTTCTA
422001 AGTGTTAGAG GAAAATATCT TTTTATTTTC TTAGGAGGCT ATAAATAGAA
422051 AATTGGTAAA TTGAGGAAAT AAGTTCCCAT CAATGTAACC CTTTAGTAAA
422101 GTAGTATAGT CAATAATTGA GAAGGCTTAG AGTTATTCAG CATGACAAAC
422151 TAGTCAAAGA AAAATAAATA TGGGCTACAA CAAGGTCTAT GAATGTGATA
422201 AGCTTGTCAG TCATTTTTGA ATCAGATATG TGTATTTTTC CACATCATTT
422251 TATGTCACTT AAATTTGCTA TCATTTCTAA TTTCCTTCCT TTAATGCTTA
422301 ATATTATAAA TTATATTTCA GAAATGCTAG CCTAGCTTGT TTATTCAAAG
422351 TAGAAGCAAA GAAAGGTTTA ATTCTGTCAT GGCTGGGCAG AATTTTAGAC
422401 AGGGAAGAGC ATGCCATTGT TGCTATAGGG CAGGAAAAAT AATTTTCCTT
422451 CTACGCTTCA TAGTTCTTAG TTGAGACAGA CTCCAGTAAC AAAAGAGATT
422501 AGAAAGAGAA AAGCAAACAG TAATTTACTA ACATGTACCT CGTGTATACA
422551 TTGGACATAC CTAGGGAATG AGTAAATCTC AAAGAGGTAG CTCTGAGTTT
422601 AGGTTTAAAT ACCATCTTCA GCTGCAGCAA AGAAAGAAGA GTTTTGGGTG
422651 GCGGAGCAGT AATGGGGAGG TAAAATCACA GTAAACCAGG ACAGGATTTG
422701 TTATGTTGAT TTAAGTCAGT GCCTTCTTCA TGGATAAGAG TTTCTAGTGA
422751 CTTAGTGATC CTTCTCTTCC TGAGAAGACA GAGAGATACA CTTACAAATG
422801 GAGATTTCCT TTGTAGATAC AAATTTTCCA TAGGAAAGGG TGATTTCTAC
422851 TTTGTTTTCA GAGCTGCTAC TGTGTCTGCA GTTTCTCAAA TAAAATGACT
422901 CAAAATAATC CTTATGCCAA AGAGGCATAT TTTTGAGTGG CGTATTCTGG
422951 TCTCCTATAG CCATATTTTA GGGTGACATA TTCTGGTCTC CTCCAGTCAT
423001 ATTTTGGAGG GCATAATTTG ATCTCCTACA TTGTTATCAA TGATCCAAAG
423051 AGAGAACCCC CAAAGAAAAG TGAAATATAG AGCTTTAGTC AAGTTTTCCT
423101 AGTCCAGACC CAGGAAGCTT TCTTTCTCAA GGCTTCTCTC TTCTACTTTT
423151 TTAAGAGCTT ACTTACTTTG TTTGGCAAAG ACTCAGCTTC ATGCTGAATT
423201 CACTGTCTTT TAAAGCCAGA TTTTCTCAGA GCGAATCTTG GTGATACAAG
423251 AGCAAACGGA AAGCTACTCT TTCACCCTCT CTGAATGTTT ACTGATATGA
423301 ACTGACAATA GCCAGATTAA GAGAAGAAAA ATGCGTAGAA ATGTATTAAT
423351 GTGCATAAGC ATGGTGAGGG GGCATATAAA ACATGAGACT TGTAGAAGGT
423401 CCAGATGGTG AAGTTTATAT ACCCTCTTTG TAGGGGAAAG GAAATGGGGC
423451 ATGTAGACAA TTGGAGGGAT AGTAAGTGAT TTTTAGGAGA AATGAGTGCA
423501 CCCAAGGAAC AATGGCCTGG GAGAAAGTTC CTCTGAGGTC TGAGGGAGGT
423551 AGTGAAGAAG ATGAAGGGTG GAACTTTAGT ATGAAGAAAA ATAGTGTTAT
423601 TATGCAGATA AAGTATCTCA GGTAATCCCT AGGAGCTGCC CTCAGAAGAA
423651 TAGATGAAAT GTCTTTCTGG GCTTGGTGAT GACTTATAGT CGTTTCTTTT
423701 TTCCAGTGGT TAATTTTTGC TGGTTGTTTG ACAAGACTCC TAGGGAAGGG
423751 CTTTTAAGAC AATGCATTTC TTCCTGGATG AAGTTCCCTT AAACAAATAA
423801 AGAAACTTCA GAGAAATACT CCTATTTGTG CTGTGGGAAT GAAAGGGGAT
423851 CAGAGAGACA GGTTGACAGG AAAGGTCAGA GAGAGATTTT GGTTTCGAGG
423901 TTTATTTCTG AGGCCCTGCA GTTTCCTCTA ATTCAAAGAA CTCCACATGC
423951 CAAAGGACCA CATTTTTGGG TGTGATTTTC TGAACCCCAA AAGCATTTAT
424001 TAGATATGTA AGGTTGGGCA AATTATTTAA CTTCTCTTGA CTCCAGTTGT
424051 ACCATCCATA TTGATAACAA TACATACCTC ATACTGTTGT CACAATGATT
424101 TAAATGAGTT AATATTTGAA AAGTGCTAAA AACAGTAGCT TGCACATAAT
424151 GGGTGCTACA TAAATGCTTG TTAAATTAAA AAGAAAGCTG TTCTCTTACA
424201 ATTCGTTTTG AAAGAGTGTC TGGTAAGTTA AAATTCAAAC TATTAGAAAT
424251 TTTATGTTGA TGCTATTTTG TCAGGTTCAC GGCTTCCATC ATTTGTATTC
424301 CTGCAAACTA AAAACAATAA TGATAATAAT ATACTGAATG CCTAAGACCT
424351 TTTCACAAAA TATATTAAGT CCTGCACCTC TAAGCCTATC ATCTGATATT
424401 GTTAGCAGTG GCAAATCTAA CAGGCCTGCA GCGACTTGAT TCCTACCTCC
424451 TCATAGGAAA GAATTTGGCT GAGGGGCATA AGTCAGTATG AGACCAAGGC
424501 AAGTTTTAGA ACAGGAGTGA AAGTTTATTA AAATGTTTTT GGAACAGGAA
424551 CAAAAGAAAG TACACTTGGA AGAGGGCCAA GCAGGCACCT TGACAGTTCC
424601 AGCTGCCTCA TTTGGCCCTT TACTTGAGGT TATATACATT GGCATGGTTC
424651 CAGGGTTTCT GTTTCTTCTC TCCTGATTCT TCCCTTGGGG CTGGCTGTCT
424701 TCATGCACAG TGGCCTGCTG GCACTCGGGA GGGGCCACAT GCACAGTATG
424751 TTTACTGAAG TTATGCACAT GTTCACTGGA GTCATTTTTT CTTACTGAGT
424801 GTTTCTAGGG GAAGGTCATA TACCGGTCAA ACTCTGCAAT TTTGCCTCTT
424851 ATGTACCTGC TTGAGCCCAC TCGTCCAATT CCTGAGATCT TATTGGTAAG
424901 CAGCTGATCA CCAGCTTCAG GTGTTTTCTA TCTATTGGGA GACCACTGTT
424951 CCCTGGCACC AGCTGCCACC AATTATGGTT TTAGAGAGAT AGTTTAACAG

FIGURE 3UUUUU

425001 CCACCTGACC ATCACCTGGT CATTGCCTGA CATTCTTGGG GTGGAGGGCC
425051 CTCTCCTGCC CTGTTCATGT CTGCCTAGCT GCCTACTCCA TCAATATCAG
425101 TGAGGTAGTC TGAATCATAC TTTGATTAGT ATGGAGTGAC CCTAGCAGTT
425151 ATTACAATGT ATGCAAAAAA AAAAAAAAAG CAAGTACCAT AAACTTCAAA
425201 ACATTATGTC TTCTAAAACT TAAAAGATGA GATTGTTGGG GAAGAAGATC
425251 AGAAAAATGA CAAGTTAAGA GGTTGTTGAA CAATTACACT TAAGAGGTTC
425301 ATGGTAAGTC CAGCAAGATA TAGAACTTTT GGGGCCAGGA ATCGAACAAG
425351 CAGTCAATCT TTCCTGTTTT TCATTAACCA CAAACAGTAG CAATATTTTA
425401 ATAGATATGC ATTCTCTCCA TGCTAGATAT TGTATTTCTA TGAATTTGCC
425451 ATTATTTATT TCCTTTATTC TTATGGTGTA TTATCTAAGA GTTGGAATTT
425501 AGATCATCAG TCATTCCCAT TACTATCTGG TGTCTTGGTC AATCTTAGCA
425551 TTTAAAACGG TGCTTTCAGA GAACCTTCTA GGGATTTAAA AGGAAGCATT
425601 TTTTGGTGTC AGGGGTAGAG AGAAAAGTAA CTAAAAATTT CAAGTATGTG
425651 ATGAAACCAT TTTGAATGTA TGATTAATAA AATGAAGAAC TAAAATTGTG
425701 GAAATGAGTA ACCAAAATAT TTGGCCAGTA AATGGCCTAG TAGGTGAAAA
425751 TTTCATAGAT AGGTATAGGA GGCAATCATA TAAATGATAA GATTTTAAGG
425801 ATGCTAAGAA GCCCGGTTCC TTAGTGATTT TCTCAAAACA ACAGCAACAA
425851 ACCTAAAATT TTTCTAGTAC AACACAGCAT GAGATTTTAC CATTAAGAGT
425901 TTTACAGATT TCTTTGGGTT TGTAGAGATG GTGTCTTTTT ATTTTATAAT
425951 CCTAATTTAT TCACATAAAG ATTATTAGGT GTCTCAAATG GCTACAGTCT
426001 AAAGAAAATT ATGTCTCACA TTCAAAGCTA ATCCTTCCAA TTGTTGGGGG
426051 ATGATCTGAT CTTTCAATTT TCTGTTGGGC CTAGCTGGTT TTGTTTATCT
426101 CCTCTACTGA ATTTTTGTTT CTGCTAACTC CTTCCTTAGA ACCTATAGTA
426151 TATATTCAAA TTTATATTAT CAAAAAAAAT GCTCCCAGTC CAATTTTTCT
426201 CTTCTCTAAA ACAAATACCT TGGAAAAATC ATCGTCATTG GCTATGTCTA
426251 CTTTTCACTT TTAATTTGCT TTTTACTCTG TTGCATTTAG ATGTTCCCAT
426301 TCACTCTACT ACAAGAAGAT TTTGTTTTTA CTACTTCTAG TAAACTGCAT
426351 AAGAAAAATT CACCAATGAT CTTCATTGAC ATTTTGTATT AGAAANNNNN
426401 NNNNNNNNNN NNNNNNNNNN NNNNNNNNNN NNNNNNNNNN NNNNNNNNNN
426451 NNNNNNNNNN NNNNNNNNNN NNNNNNNNNN NNNNNNNNNN NNNNNNNNNN
426501 NNNNNNNNNN NNNNNNNNNN NNNNNNNNNN NNNNNNNNNN NNNNNNNNNN
426551 NNNNNNNNNN NNNNNNNNNN NNNNNNNNNN NNNNNNNNNN NNNNNNNNNN
426601 NNNNNNNNNN NNNNNNNNNN NNNNNNNNNN NNNNNNNNNN NNNNNNNNNN
426651 NNNNNNNNNN NNNNNNNNNN NNNNNNNNNN NNNNNNNNNN NNNNNNNNNN
426701 NNNNNNNNNN NNNNNNNNNN NNNNNNNNNN NNNNNNNNNN NNNNNNNNNN
426751 NNNNNNNNNN NNNNNNNNNN NNNNNNNNNN NNNNNNNNNN NNNNNNNNNN
426801 NNNNNNNNNN NNNNNNNNNN NNNNNNNNNN NNNNNNNNNN NNNNNNNNNN
426851 NNNNNNNNNN NNNNNNNNNN NNNNNNNNNN NNNNNNNNNN NNNNNNNNNN
426901 NNNNNNNNNN NNNNNNNNNN NNNNNNNNNN NNNNNNNNNN NNNNNNCTTT
426951 TAGGGCAGGC ATTTCCTGAC TGCCCCCCTC AAAATAAAAT TATTCGCAGT
427001 TACTCCTTTT TATGTCATTG TGCTTTCTTT TTTATAGATT ATATCATTCT
427051 TAGAAAATAC TTGGTTTATT TATATACTTG CTTCCTCATT TGTTGTCATT
427101 CTGTCCACAA GAGACTACAA GGTACCTGGC ATATAGTAGA CACTAAGAAC
427151 CTGATGAATG AATAACTAAT AATTTCAAGC TCAACCTGAG TTAGCCAGTA
427201 TTATTGCTTT CTCTCTCAGA CTGCTTATCA AGCCTAGCTT TTGTTTCTGT
427251 GTCCTGATGA ATCATCATCA ATCCACCCAT CTAAGCCATG AAGCTTAAGT
427301 CATAACCCCT ACCCCTGACT TCAAAATAGC CTTTCAGTTC TACTTTTTAG
427351 CATTTCTTCT ATCCATTCCT TCTTGTAAAT TCCTGGCCTT ATCCTTTTAG
427401 TTAAGACTCT CAACTTTCCT TTGGGTTAAT TTAACAATCT CCTAGCAACT
427451 CTCCTTCCTT TAGTCTTCCA TCCTTCCTAA ATATCTTCCA AATTATTAGA
427501 AAGTATTATT TCTAAATGAA CAACAATAAC AATGAAAAAC TTTGATCATA
427551 TCCCCACTGC TGCTTATAGC CTTTCACATC TACAACCCTT CTTTGCCAAA
427601 ATTATAAGTC AATCTAAGGA CATCCAAGGT TCAGGCTTGG TCTGTCTCTC
427651 CCTAACCAAC TTTAACTTTA CCAGGATTTC TCAAACAGTG CTGGATCTTA
427701 ACCCAGTTAT TCCCAGTTAT ACCAGTTACA TACCTGCAGG TTTGGGCTTC
427751 CTTGTTTTTC TTTTTATTGT TGTCCTTGTT GTTTTCTTTT TAAAAATTCA
427801 TTGTGTTTCT TTTGCATTAA CTGAAAAATA TATTTTAAAA ATTAGGAATA
427851 AGAAATTTAA AAAGAAAGCT GAATGTTTTA TCTAATGTTT TAATATATTT
427901 CATATCCTCT TAACTTTTTT TCTCAGGTGA CTCATTAAAT ATATGCTCTG
427951 TACTTTAAAG AATGAGCTGT GGAGGACACT CCACACTATC AGGTCTTGGT
428001 CAATTAGGGC TGCCTCTGGG AGCAGTTTGG AGTACAGGAG ATCCTGCTAT
428051 CTGCCAAGAA GTCTGTTATC AAAATAACTG TCCAAGGCTT TTCCAGGCCA
428101 AAAGGGAAAA ATAGTCACTG AGGTTGGAGA AACAAAGTAG GCAAATAAGA
428151 GTTATTTTAA AAGTACTTGT CAAGCAGAAA ACACAAAGTA GGAGAAGATG
428201 GAGAGGAATG ACGTAAGAGT CTAATAGGTG GGTGAGTGAG AGGTTAGAAA
428251 AAAAAATCCC ATGGTCTTAG CACTTTTACT TTGATGTTTT TCATGTATTT
428301 AAATCAATAG AGAAATTGTC TTTTAAAACT ATTAAACAGG TGCTGGAAGA
428351 TTAACGCATT TAACAAACAT TTACGTTGCC TACTTAGAAA AGTTCAAACA

FIGURE 3VVVVV

428401 TAAAATGTAA GTCATACACA TGGGTAAATT CTAATGCGTA CCCTTAGGAA
428451 TTTCTTTTGT ATTGTTTTAT CTAAATATAC AATCAAACAA ATACCTATGA
428501 GTGAAAACAT TTTGCTACAA CTTCATTCTT AATACACAGG CAAATATCAA
428551 GTCTTTGTGT TTGATATACA GTGACAGTGA TTGGGAAGAA AGCATAAAAC
428601 TTGAATTTAC ATTTGCTCTA AGGCTAACAG TGTAAAGCAT GGTTTCTTAG
428651 TGCTGGAATA ATTGGCCACT TGAGAAAATT ATTATTCTCT CACTCTTACT
428701 CTGCGTAGAG CAAATGGTGG TTGAGATGTA GTTGGAGAAG TATTCTTTCC
428751 TCTTTTCAGC TGCTCTAGCC ACATCGCCGC TCCTAGGTAT GCTCAGGATG
428801 CTCACAATCC AAGCATCCCT GTTCTGCTTG TTATCTCTTC TTCCCCCGCC
428851 ATCTCATTAC TTTTTTTCTC TTTTTCTTAA ATGTAAGTTT TGCATAAAGA
428901 AAACCATTTT GGCCCTCTTG CTTTTCCATC TCACAACTGA AATTCAAAAG
428951 GACAGCTGAT TGTTTAGGTG ACTCATTGTA CAGACAATGC AGCATTCACG
429001 ATTTTGCAGA GCCTAGAAAG GGAGAAATTG CAACGACAGT TTGTTTTTTT
429051 TGTTTTTGAT TTTTTTTTTT TACCTCAAGC AAGCTGTTAT ATTTTAGACT
429101 TCACTTATCA TAAAAAATAAC TTAAATATTC ACTTCGTATA TTGCAATGCT
429151 GTATTTTTAA AATTAAAATA ACCCTTACAC TACTGAATAG ACACCTATAT
429201 GTAATGAATC CTCGTTTCCC CAATTATAAA TTACTGATAG CATATCACTT
429251 GAGTTTGATG GAGTTGCCTA AACACATATA CTTTAATTTA CATTTCAGCA
429301 GAGGTTCTTT TATCAAATAA TCTGGGAGAG TTTCCTCTAT TATAAGGCCA
429351 TTCTGCTGAT GTTGGAGAAT CGAGTTACCA CTTGTTGCCA GTATGTCTTT
429401 ATTCCTGACC TCTGCAGTTG TATCTCAGAA AGAATTGTCC CACTCAATAT
429451 CATCTGTTTG TACAAAACAG ATCATTATCA AGAAATCATT CATAATTTGA
429501 AACAGAACAT CCATAATTGT TGCTACAATG TTATGCATTT TGAGGAAAGT
429551 TTATTAATTT GCTTGAATTT ATTCATTAAT TGTTTTGCTT TTCCCTCTGA
429601 AATTATGACA GTGCTCGGAT TTTTCATATT TCTCTTTCCA TTTCTAATGG
429651 ATGCTTGTCT AAAAGTAATT TACTCAAACA TGAAAAAGGC CATATGTCAG
429701 TGAGCATGAT TTTTTCCATG GTATTAGGGA AACTGGATAA TGTTTAACTC
429751 AAAAAATCTA AGGCCAGGTC CTCATTATTT TATTTATATT TAAGTGCTCT
429801 TTTTCTCATT TGTGTGATTA TGTTTACTTT TACTATTGAT CTGCATATCT
429851 ATAATACATT TCTGTAATTA TTACAATTAG TTATTCTATG GACTAATATT
429901 GAGGTTTTCT TCTTGCATTG ATAAGGATAG TTGATAGCTA CCATTTTGGA
429951 AATTTCCCAA GCTAAAATTA TGTACATGCT GTATGGCATA GAAACTTGAA
430001 GATGCAAATG CTTACTTTTC AGGTTTTCAA GTGTCTAGAG AACTGTATTT
430051 TGAGAAATTT TTATTCTCTC CTAATGGGTA AAGAGATGGT GGCACCTTAT
430101 TCTCTTATGG GTCTTTATTA GTTAATATCA GTGTTCATAA TATAAACATT
430151 CCCTTCTGCT TCAAATAATT TTCATGTAAT ATAGATCTGT TCTTAGTAGC
430201 ACTAGGCTCT TAAAAAATTA TAACCTTGAA TTATCTGCTT TACAATACTT
430251 GTCAAAATTT GTACTATGTG CAATATAATT CTTAGAGAAT TGCACAAAAC
430301 TATGCATTGC ATTCATTTCT TTAGTTAAAA CATGTTACCT TTGGTTCAAG
430351 CTAGATTAGC AGACTTGTGC CTATGAAAAA AATTACTTCA GTGTAATATG
430401 TGCATTATTT GCTAAGTGTC AATCATCTCT TCTATAAAAT GGGGATATTA
430451 ATAACCATTT TACAGGGTTA TTGTGATGAT TGAGTGAAAC AAATTATGTG
430501 AAATATTAAG TACACCCCCT TACAGTTAGC TATATTTTTT TCAATACATG
430551 CTTACCAGGT ATAAAAGTGA TCAGTTCTGA CAGACGATAG CAAGGAGTTG
430601 TCACAAAGGA GGTAACAACT AAATCAGAAT ATGAAGGGTG AGTAGGAATT
430651 TTTCAGAGAG CAAAAGGCGG TAAAGGCAAT TCAGGAACAG TAGGTACAAA
430701 GGCAAAAGGG AGCTAGAGGC TAAAGAATGG ACGGGGGCCT GGTATGAAGA
430751 CACTTGTAGA CAAAGCTGAG AAGTTTAGGT TTTATTCTGG AAATGAATGG
430801 TATTTGGTCT ATTCGATTTT TTGTTTGCCT GTTTTAACTA TTAACTTTAA
430851 AAATAAAATA ACTTCTAAAA GTTAACTAAA TCCTGATTGA TGGGACTATG
430901 AAAACATTAA TGCATAACAA GTTTTGTTTT AGGCATCAAT TTAATTACTA
430951 AAAGTAGGTG CAAGCATATC AAAGATAATC AGAAGCAATC CGTTTTGCCA
431001 TATGGAATGC AAAAGATTTG AAGTGTGCAT ACTCCTGAAT TTTGAGTAAT
431051 ATTTACTTTG AAAACTTAAG TTTCAGTTGC TCTTCTGTAT ATAAAATTAT
431101 TTAAACCCTC TAATAGCATT ATTTAAGGGA GTCTCCTATA GGAAGGCAAT
431151 AATCAGTTAC TAATTTGTAT GTTTTGAAAA TGTGTATTTG ACAATACTTT
431201 GAAAACAAAA AAAACTATAT AAAAATACAG TAGACCCTTG AACAACATGG
431251 GGGTTAGGGG CACCAATCCA CTCCCCACTT GCTGTTGCAA ACCTGCATCT
431301 AACTTTTGGC TCACCCCAAA CTTAACTACT AATAGCCTAC TGTTGAACAG
431351 AAAGTGTAAT TAGAATATAA ACAGTTGATT AATACATTTT ATATGCTACA
431401 TATTATTTAT TATATTATTA CAATAAAGTA AGCAAGAGAA AATAAAATGT
431451 TACTAAGAAA ATCGTAAAGG AAGATAAAAT GTATTCACTA TTTATTAAGT
431501 GAAAGTGGAT CATGATGAAG GTCTTTGCCC TCATTGTCTT CAGGTTGAGT
431551 AAGCTGAGGA GGAGGAGAGA AAGAAGGGCT TGTTCTTTCT GTCTCAGGGG
431601 AGGCAGAGGC AGAAAAAGTG GAGGAGGTGA AAGGGGAGGC AGGAGAAGCA
431651 GGCACACTTG GTTTAACTTT TATTGAAAAA GATTCCTCAA TGTAAGTAGA
431701 CCCATGCAGT TCAAAATGCA TGTTGTTCAA GGGTCAACTG TACATTTTCA
431751 TATATATTTG TCAGATTTTC TATTTATAGG CTGAATATGA TGTAATAGGG

FIGURE 3WWWWWW

431801 TTTTTAATAA TCTAAACAGA TAAATACTGG CTGTCATTCT ACCACTAATG
431851 GACTGCATAA CCTTAATGTA ATTATTGTCC TTTTCTGAAC CTCGTTTCTT
431901 CATCTGAATA TACTGATATG GTTCCTTCCT GTGCTAAGAT TGGAGCTCCA
431951 GTTTTGTGAT TGCCATTCAT TTCCAAATAG AAAAAATTTA ATAAACAAAA
432001 CATATAGATA GAGAAAGAAG TGATTTAGAG AAAGAGAATA TGAAATTCAT
432051 TGATACGTAT GTATCAATAT CATATCAGTG AACATGATAT TCACTGATAC
432101 GTAAAAGCAT TTACCTAACC ATCTTTAAAT GGTTCAGTGT GTTCCTTTAA
432151 TCTTGTCTTT AACCCAGATT AGCATAGAAC TATTTTTCTC TCATTTGTAA
432201 ACTCAGAAAT ATGAATAAAT TTGTTTTCTG TTAATAAACC ATGCACTACA
432251 TTCTTGGCAG TCATTAAATT AACAAAGGTA GTAACTTAAG AACTGATTAA
432301 ATATAGCTTA ATATGCAATT GTCCTTTCAT GACTTGGTAT ACTTCAGATA
432351 TTTCGGTGAA ATTTTTATTA TTGCTTAAGA TTTTAAAAAG TACCTCTGCA
432401 AACTATGATT AGTTATTGAC TTAATTGGTG AGCAGTCACT TTTCAGCCCA
432451 TATGAAAAAT CCCCCCTGTT TGTTTATGGG TTTAACATAT TTTTATGATT
432501 ATAAACGTGA AACATAAATC TGTACTGGTT GATGCGACAA CTGAAATATG
432551 GCCCTTCAGC TTGTTCTTCT TCTGTGTCAG ACTTTATTTA AGCATGTTCT
432601 GCAGAATGCT AGTATTCCTC TAGATGATCC TTGGAAAATA AGATTCTATG
432651 AACAAATTTT TGGGAAATGT TGGATTCAAC AAAGTGAAGC AAATAGTGTT
432701 AATTTTGTTT CCACATCAGT CCACCAAAAG AGTCTTATTT GAGCAACAAA
432751 CTGATTTTTG TGTGATATTT CATGGGACTA GAAGGATTGC ATAGGACATA
432801 TTTTGGGAAA CACAGTTATG TTTAAAAACA ATTTACATTA AAAACTTAAA
432851 TGAAATAAAA CAAACAAAAA TCATAGCACA CCTGGCCTCT GCTACTCCGA
432901 GAGGAAGATT GGGACCTACC GGGACAGATG TTTTTCTGGT AAGGGAGAGT
432951 CTACCTTGCT ATAAGTATCT CGTAAGTTTT ACTGGTAGAG CACTGTTCCT
433001 TTATTCTTTA AGTTATAAAG TAGTAAATTC AAATTGAAGC AAAAGTAAAA
433051 GTGTTTTCTA GTTAAAAAAA AAAAGCTAGT GGAAAATAAA ATTGTAGCAT
433101 AACTAATAGA AATTAAGTTG TAGTTTTTAG GTAGTTTATT ATATGATGGA
433151 CTTGAAAAAC AGCTAGTTTC AAATCAGAAT AATTGCCTTT TTCTTATGAA
433201 GTTAGTCTGG AGGGTGAAGA CTGGAGATTG CTTTCTTTCT GTGTGAATTA
433251 GTTGTTTCTT TTAAAGAAAC AAAATCAACA TAAGGAAATA CCTGGGAGTT
433301 TTCAATACAG ATGTCTCCAA AAGTATTATT GCTGCCATGT TATTTTTTCA
433351 ATGTGTCACA TAATGTTTAT ATAATTTATA AATGATAACA AAGCAATCAG
433401 GCCACATTCA TAAAAGCCCA GTGACACATC ATTTAGTTGA ATCTGAGGAT
433451 TAGAATTAAT TGTCTCTCTT TGTTCCAAGT TCTAAATCTT AGTAAATGAT
433501 TCACTGTATG TCATTACAGC TTAATATTTG CATGAAATCA CAGTTTAGCT
433551 GGCATAATTT AACAGCAATT AAAAAGCTAT TTAATCATCA TGCAAATTGG
433601 TATGAGGGCC CTTGAGTAAG AAGGGTGTCA GCCTTCTTGT TTTTTTTTTT
433651 TTTTGTTTTT TTTTTTAGTA TCTGCAGGCG GACAGTTATA TACTTATAGA
433701 CACCCATAAC ATAATTGATA ATATTCTTCC TAGAATGAAA ATATAAGTGA
433751 ATAATAATTC CTGCTTTCCA TTATAAATAA GAGAAAAGAC CAACCATATG
433801 AATATGTCAT TCTGTCGGAA AACATTATTA TGATAATGAC AATGAATCTT
433851 TATCTCCTAG ACTAAGTCTA GGTTGGAGGT AAAAAGCTAC GTTTATCCCT
433901 GTTCTCTAGT GTATCATCCC CTTCATGTTT GCCTTCCTGA AGGTAGACGT
433951 TTCTGTAAAC CCTATGGAAT ATGAAATGGC ATAAAGCAAG GCACCCAGCA
434001 ACCTTTTAGA AAAAATGATT CATTGCATTT CTAGGTGATG TACCTATAGG
434051 TAGCTGAGGT CCCTTCCTGT TGTACATAGA AAACTATCCA TACTCATTCC
434101 AATGAGCCTA GCAGTCCTGC ACTATCTAGC TTCTTCCTGT TCCTTAAATC
434151 TTACTTCATG CATTCTCCCT CTGCAGTCTA GCCACAGTGA CTTTCTGCCA
434201 GTTCCATGGT TATTTCAAGA TCTTTCTGAA CAAGAATGGC ATACTTTCTA
434251 TTCCTAATAT TTTTCCCACC CCTCTGCATA TTCTCCTCAC CACCTCTATG
434301 AGGCTTTCTC AGGAATGTTA CCTAAAACAG GGGTCCACCT GATTGCTTTT
434351 ATTTCAGCAC CTGTCTTTCT AATTTTTGTA ATTGCAAACA TTATGATTTG
434401 AATTTTATTC ATCCGCTTAC ATAGATCTAG TCACTCCACC AAAATGTAAA
434451 TAACAAGAGA GAAGGAATAA TGTCTACCAT GTCTTATCTC TGTAAGCCCA
434501 AGAATCTAGT AGAGTATCTG CCACATAGTA GACACTAAAT AAAATATTTA
434551 ATGAATGAAT GGCCGTAGCT TGAAATCCAA AAGGAGCCTA TATCAAAACT
434601 TGAATTTATT TCTAGGAGCG AATGCTAGGG AGACATTGCT TTCCACGCTC
434651 TAAGCAGAGT TTCTTGGTAA CAGAAATTAG AGAATTGGTT TAGATTTTTT
434701 TTTTAAATGA AGCCTTCTAA AATATGGCGT GACTGTTGTT TCAACAGTCA
434751 TTTATATAGT ATATTATTTT TCTAAATATC TCTCATAAGT ATAGCCTCTC
434801 ACAGCATACG GATTCTGTGG TTTTTCACAT ATAGTACTTA GCATAGTGTC
434851 TGGCTCCTAG AAGACATTCA GGTAATATTT GTTTAATGAA CATTATAAAA
434901 CTGAGGCTTA AAGGACTCAG ATAAGTATAT AGGATTATTC ACACAATTTT
434951 AAGGAAAGGC TGGAGTAATT AGCGGCTATC AAGCACTCTA CACGGTGTGA
435001 TCTTTGTGGA AAATAAGAAG ATGCTCATCC CCTCCTTAGA CTGACTTGGT
435051 TTTCGAGGTC TTTATGACAA ATAGGAGAAT AGTGTGGGTC TCTTTTAGGC
435101 CCACGCTTAG TTTAAAGGAC ACACCTACTT GTGTTTAGTA AACTTAATCT
435151 AAATGAAAGT CCTGCCATCA TTTCTTGTCA GTGGCCCCTT TTTATCCCTT

FIGURE 3XXXXX

435201 CCATATCATG CTTTTATCAC ATCAAATTGA CAAGGACTTA ATAAAAGGTT
435251 TTTTGTTGCC TTCAATTTTC ATTTCGTTTT TCCTTTTTCC AAATCATCTG
435301 CTCACCCTAA ATTTATGGTC ATTTAATCTC AACCTTTGGG AAACAGATTT
435351 TTAGTGATTT TCGGAGGTGA TGAATGGGGA TTTTATCTAC ATATGAATTA
435401 TAGTATGAAG ACTGAAAAAC TTACAACAAT GTGTTTTGTA TATGTATGTT
435451 ACTATTTTTT TTCAAATTTT GAAAATGGTG ATATAATTAA TAAGATGTAA
435501 TTAAAGCCAT CACATAATTT AAAATAATTT TTGTTATATA TTTTCAGTCA
435551 AGTTTAAAAG GTGTAATTAC CATATGTTTT ACAGATATCC TGATTTTTAT
435601 ATTAAATATT GAAATTCATA CTCCAAAAAT TTATGATATA GATCTTCATT
435651 CCTCAAGACT CCTTCCCTAC TAGACCTAAT GAGCTATTTT AACCATGTGA
435701 TCATTATAGA TCCCATTAGA AAAAGAGTTC AAACTAACAT AAAAGAGCAA
435751 CAAGTGTTTA TTGATGAAGT TTTCATTTTA GCGCCATAAT TCATTGTCCT
435801 ATATATGTAC ATTTGTTTTT TAATTGCTTT TCTCTAGGGC CACCTTCAGC
435851 TCCTAGGAAT GTGGTTTTTA ACATCAATGA AACAGCCCTT ATTTTGGAAT
435901 GGAGCCCACC AAGTGACACA GGAGGGAGAA AAGATCTCAC ATACAGTGTA
435951 ATCTGTAAGA AATGTGGCTT AGACACCAGC CAGTGTGAGG ACTGTGGTGG
436001 AGGACTCCGC TTCATCCCAA GACATACAGG CCTGATCAAC AATTCCGTGA
436051 TAGTACTTGA CTTTGTGTCT CACGTGAATT ACACCTTTGA AATAGAAGCA
436101 ATGAATGGAG TTTCTGAGTT GAGTTTTTCT CCCAAGCCAT TCACAGCTAT
436151 TACAGTGACC ACGGATCAAG ATGGTAAGTT CCACTGCTGT TCTCTCAAAA
436201 CAGACCCATA ATTTCTTTTG ATGCATAAAT ATCCCTCATG GGCATGTATT
436251 TATTGCAGGT GCTATGCAGT CATATACGTT ATACACTGCA GAGGTAATGC
436301 ACTGGTTGTT GTTCTTGTTC TTTCCTAAAA CTCAGAAAGA TATTTTTATA
436351 TTACTTCTCA GCAGTATGAA TAATAAGATG AAATGCTTCC CTCCACTGTT
436401 TATGTACTCA TGTATTTTGT ATAATCATAT AACAATATAT CTTAATGAGT
436451 AAGTCCATAT TACTTACCAA TAGAAGTCAG AAATCAATAA AATGTTATTA
436501 AATGAATTGA ATTTCAATTG CCCCACTTAT GCTGCCATCC TTTTTGCATG
436551 TCAAATAAAG CAAATAGTAA GAATTTTTAA AACTATAATT CATGTCTATA
436601 TTATGAAAGC ATTCCAACTA ATATATTTGT GTTCCACTCT AAGTAGCAGA
436651 AAAATTTAGA AATGTGTTCA AATGTCATCA TCTATGTGAA GTTTGTGAAA
436701 AGTAGTTAAA CTGTTCAGAA ATCTGATGAA TTCAGCTAAA TGTTCTCTTT
436751 ATAACATCAT AGATTTTTAC TATAATATGG TCAGGCGCAA ACACTCCTAT
436801 GATTTTTACA AGTATATACT TTCTTTAATT CCTTCATAAC ATAATTATAT
436851 TGCAGACCAG GAAACAAGAA AAGCTTCAGA GATTTTTAAA ACTCCTTTCG
436901 AGAAGTGTTC ATAAATTATA TGGGCACACA AGTTATTGCC TTATAGTAGG
436951 AAAGTATTGT AAATGAACAC ATATATGAGC AAAAATTTAT AAAGCATAAA
437001 ACTATTTTTA TACACCACAT TTGTTTGCTA AGGCAGCCAT AACAAATAAG
437051 ACAGGCTGTG TGGCTTAAGC AACAGACAAT TTATTTTCTC ATAGCTTTGC
437101 AGGCTAGAAG AATCAAGTTG TCAGCATTGT TGATTTCGTT CTGAGGCCTG
437151 TGTCCTTGGT TTGTAGGTGG CCATCTTTTC CCTTGGTTTC ACAAGGTCTG
437201 TCCTCCTTAT GTCTAATCTC CTAATCTTCT CTTCTTATAA GGACATTAGT
437251 CATATTGAAT TAGGACCCAC TCATATGATC TCATTTTACC TTAATTACTC
437301 TTTAGAGACC CCATTTCTAA ATGCAATCTC ATTCTGAGGT CCTAGGGGTT
437351 GTGACTTCAA CATATGAATA TGTAGAAAGA CAATTCAGCA TAATATACAC
437401 AATGGCAGCA TATTTAAAAT AAAATACATT GATTTGAATG TGTTGTGATA
437451 ATACTCAGCA ATAAAAATGA ACAAAGTGGC ACTATGCAGA CTGAAAAGCC
437501 TATTTCAAAA GGATGCATTC TGTATGATTC CACTCATATA ATATTCTTGA
437551 TATAATATAA TTACAGATAT GGAAAACAGA TTAGTGGTTG CCAGGGCTTA
437601 GAGATTTGGA GGAGGGCAGT GTGGCTATGA AGTGGTAGGA GGGAGGACTG
437651 TGATGATAGT TGTATATCTT GATTGTGGTG ATAGTTACCT GACACTACAT
437701 ACGTGATAAA TGGACATGTA CATGATAAAT GTCATGCACA CACACACACA
437751 CAAGCCCTGT AGATTGGACC AATGTCAATT TCCTAGTGTT CCATGATATT
437801 ATACATAAAT TCACTTTGCT GATAATCTTC AGAAATACCT CTAATAAATA
437851 AAGCAAAGCC ATATAATATT GTACACTCAT AGTCTTTGTA TTTACTGTGT
437901 AATTTTCCTC TTCATTTAGC ATAGTTCCAC ATCATAGAAT TTGCTTTATG
437951 GTTATTCAAA ATAGAATTCC TATTTTCTCT TTTCTTTTCC TCTTTCCTTT
438001 AGTATCAACA AAATCTTGTC AAATATATCT TAAATATAAA GTAGATGAGA
438051 GTTTTCTGTT CCTCTCTGCT TCAGCAGATG ATTTTGAAGG TTTTTATTGC
438101 CTCAACCTTA TCAAAAAATA CAATCTAGTA CAACGATTTT TAGCTACAGG
438151 GAAAAAAATT TAATTTCTGT ACANNNNNNN NNNNNNNNNN NNNNNNNNNN
438201 NNNNNNNNNN NNNNNNNNNN NNNNNNNNNN NNNNNNNNNN NNNNNNNNNN
438251 NNNNNNNNNN NNNNNNNNNN NNNNNNNNNN NNNNNNNNNN NNNNNNNNNN
438301 NNNNNNNNNN NNNNNNNNNN NNNNNNNNNN NNNNNNNNNN NNNNNNNNNN
438351 NNNNNNNNNN NNNNNNNNNN NNNNNNNNNN NNNNNNNNNN NNNNNNNNNN
438401 NNNNNNNNNN NNNTTGCTTC ATAACTTTAT ATATATATGA AACAGCTTCA
438451 AAATTACAAT ACCAATACTA ACATCAACAA TATCATTATT AAAACAGTTT
438501 AATAATTTTT AAATAAGAAA AAAGTTTTTC TTATTTAATT CTTAAAGCAA
438551 ATTAAATTTC TTATTTAATT CTAATATCCC ATTGATATTT GTGTTAAATC

FIGURE 3YYYYY

438601 ACTGTGTTTA AAGCTATGTT TAACAGTTCC CTCTTGGAGG CTATGTCTCC
438651 AATTCAATAC AGTATTCTTC ATTTGATGAT TCTGTTGATT TTTCAAAATT
438701 GTTCTTAAAG TTATTTATTT GTTTATTTTG AGACGGAGTC TCACTCTGTC
438751 GCCCAGGCTG GAATGCAGTG GCACTCTCTC CGCTCACTGC AAACTCCGCC
438801 TCCCGGGTTC ACGCCATTCT CCTGCCTCAG TCTCCTGAGT AGCTGGGATT
438851 ACAGGCGCCT GCCACCATGC CTGGCTAATT TTGTGTATTT TTAGTAGAGA
438901 CGGGGTTTCA CCGTGTTAGC CAGGATGGTC TAGATCTCCT GACCTCGTGA
438951 TCTGCCCGCC TCGGCCTCCC AAAGTGCTGG GATTACAGGC GTGAGCCACC
439001 GCGCCCGGCC TTTTAAAGTT ATTTTTAATC ATTTATAATA TTTTTATATT
439051 ACAAAGTAAA TTTGCAAGGC AAAATATATT CATAGATGTC CAGTTTCTAA
439101 CCTTGTAGTG TTTATCCTAT TGCCTTTCAC CCACTAAGGG CAACCATTAT
439151 AATTATTTGT TATTCTTAGG TTTATCCTTA CAGCTTTTTT ATGCATTTTT
439201 CTTCACCTTA CTTTCTTCAG TTAAAAATAT ATTCTGAAAT AACTCTATTC
439251 TAGTGTTTAT AGATAGCCAT AATTCCTTTT TATAACTTCA TAATTCTCTA
439301 GTGGATATAG CATAGTTTTT CAACCACTCT CTTATTGATG GGCATTTAGA
439351 TTGTTACAAT CTTTAGAAAT AAATCTCCAG GAATGGTATT GTAAATATGT
439401 CACTTTGTGT TGTGCAGTGT ATCTCTGAGA GAGATTCCAA AAAGCCAAAG
439451 TATAAATAAA TACATAATTT TTGCCTTAAA TCTTTAAGCT TCCCTTCATA
439501 AGAGTTGTAT CATTTTGCAT TACCACCAAC AATGTGGTAA AGTATTTTAT
439551 CCTACAGCCT AGCCAACAGT GTCTTACCAA ATTTTTGTAC TTTTTTTGTG
439601 CCAATCTGTT ACGTGAGAAA TGGCGTATCA ATGTGTTTTA ATTTGGATTT
439651 TATTTTTTCT GAATGATTGT TGACTTTTAT GTCAAAAACT GCTGTTTTTT
439701 TAGAAATTAG AATACTTAAA AAGTATTTTC TAAAAGGTGC AAAGAGAAGA
439751 ATCTGAGAGA TATATAGTTT AGTTATATGT TAGAAGCTTA ACACAGATTA
439801 TTTTAATTTA GAATTATAAT ATATGGAAAA GTAAAATAGA CATGATTCTG
439851 AAAATAACTT CTAAAGTTAA ATATTTTAAC TTTGTTTAAT GTCACAGAAA
439901 CTATGCAAAA GAAATAATCC TCACATTCAT AAACAATCAT TTATTGCAGT
439951 TATAAAGCTT ATAATATAAA CTTTTTTGAA GCCTTAAAAT GTCTAGAGGA
440001 AAGGGAGAAG CCTATAAATG ATCTTGTAAT TGCAGAGTTT GTTTTTTCCT
440051 ACAGTAGATC AATATTTGAT AAAACATACG AGCCAAGTGT ATTGTATTTC
440101 ATGTTATAGC TCAAGACCAA AACCATTTTA AAGAAAAATA TCCTCCCCTA
440151 ATAATACCAA AGATGATGAG TTCTGGCCCT TACTCTTGGA ATATTTGAGT
440201 TTTTCCTGTG TTCCCTAAGA GTGTTCCTAA ATATATTTAA TGCCTTATTT
440251 GGATCGAATA GAGCATATCG TAAGGCTATC TTATTAATCT GCCTTCAATA
440301 AATGGTGTCC TCTTCAACAA GAATTTTATT TTCCTTGGAA GAGAAAATAT
440351 TAAAGAAAGG ATAATGGAAA ATGATTCCTG CCAATTAATT CTTAGTTATT
440401 TTCTTTCCTT TCAGCACCTT CCCTGATAGG TGTGGTAAGG AAGGACTGGG
440451 CATCCCAAAA TAGCATTGCC CTATCATGGC AAGCACCTGC TTTTTCCAAT
440501 GGAGCCATTC TGGACTACGA GATCAAGTAC TATGAGAAAG TAGGTCTTAT
440551 TTGGAGCTTC CTATAAAACT ACATATATAT GCATATATAT GTATATATTG
440601 AGCATGTCGT TATACTATAT TATTTTATTT TAAACCCTGT TCTTCTTTGG
440651 CCTAGCCTCA TACCTTCTGT TTCTTTGAAT CCTCTCTAAC TTACTATTCT
440701 GCTTGTAAGT TATTGATTAA TTTATCTTGT TTTGTGTCAG ATTAAAGTAG
440751 AAGATGTAAG ATGTTCATTT CTGTCATGAC CTACTCTAGA GAGTTTTATA
440801 ATATTGTAAG AAGAAGTAAC TTCTTCAATT TATTCAATTT ATAGTTTGGT
440851 TGCTAATTGT TTCTAAAATT CAGATGGGAA GAAATTTTAA TATTGAATTA
440901 CTATAACCTG AAGTGGGTTT TTGTAGCACA TATCCTTTGC CAGTGTGTTT
440951 AGAGTTACAG TCGGCTATAA TTTGGAAAGT ATTATTTAAG GGATAAATAG
441001 AAATAGCATA TAAATGAAAC ACTTTCTTTA CATTCAGGTT AGCTATTTTA
441051 TTTTATAAGC TAGCAAGATA AATTCAGTTG ACAAATCCTT ATTTATAATA
441101 ATGGAACCCT TATTTCCATT TTTGTCATAC ATTAGTATAT TTCCCCATTA
441151 TATACTTTAT TCCCTTTATT ATATTTATGT TCTTTATGCA TTTTTCTCTC
441201 ATTCCTCACC ATTATGATAT TCTTGGCATC AATATTACAG CAGACCACAT
441251 AGTCAATTCT GAAGTGTCTT ATTGTCTTAA TACTACTTCT AGAAGTATGC
441301 AAAGGGAATG TTAAATAAAA ATTTTAATGT AAAAATTATA TGTAATATCC
441351 AGTGGTATAT TACAATGAGA AGGAACATCT TGCATTTCTG TCCCTTACTA
441401 GAAGCAAAGG AAATCATAAA GGAATTTAGT CTTCCTCTGA AGAAATAGAG
441451 GGCAAGAGGA GAAATAGAAC TCTACTTTCT TAGTTTATTT TGTCTGCTGT
441501 AACAGAATAC CACAGATGGA GTAATTTATA ATAAACAGAA ATTTATTGGC
441551 TTATGGTTCT GGAGACGAAG AAGTCTGAGA TCGAGGACCC AGCATCTGGA
441601 AAGGAACTTC TTGGTTATTG ATCTCATTGT GGGAGGGCAA GGCCAGGGTG
441651 AGAGAGAAGC AAAAGGAAGT CAAACTCATC CTTTTATTAG GAGCTTACTT
441701 CTGCAATATG AAACCCACTC CCATGGTGAC ACCAATCCCG CAAATGAAGC
441751 CATAGTCTTC ATGGCCTAAT CACCTCTTAA AGGTTCCATC TCTTGATTCT
441801 GTTATAATGG CAATCAAATT AAAACATAAG CTTGGCAGGG ACATTAACCA
441851 TAACACATAC CTTCCTCTAT TCTACTGCTT CAGAGTTAAT CTAGGTTTGA
441901 TAATGGGAGA GGTAACTTAG TAGCATAGCT GTATCCATTT TTTGTTGCTC
441951 TAATAATTTC AGCATTATGT AGTCAATAAA AACTGTCATT ATCTTTAAGT

FIGURE 3ZZZZZZ

442001 GACATAGATA AATCCATAGC CTAAGAAAGG ACAAATTTAC TGAGTTTAAA
442051 TTGGAATACA GATTCTGCAA ATTATCCTGG CCAATATGTG CTCAGAAATC
442101 TGCTGGGCTA GCCTTTCAAA TGTTACAGCC TATAGCACAC TATCACAAGA
442151 AAGCATATGT TTTCTGTTGA CTGGTTTAAA TATATTTTCA TACACTCAAA
442201 ATTTCTGACT ATTTAACAAG CAATGTGCAT ATATATACAA GCAACTTTTC
442251 AGAATCAAAA TATTTCTCTG TGTTTTATAA GGGGTATATT TTACACATAG
442301 AAAAATCACT GTCTAATTTT ATAGTCATTT ATACCTGATA TGTTTGAGGA
442351 TGAAAATGAC TTGCAATATT TCTAAGTTAG GATAAATCAT ACAGATGTAA
442401 TAGAAAGAGA ACCACATTCA TCCAATCAAA ATTTTATAAA TTAATATGAT
442451 TCTAAAAGGA CCTAGAAAGA TCTAGATCTA GGTAATCTTT TACAGTTCTA
442501 GCTATTGTCA AATGCTAATG TTTGTGTATG TACTGTTATA TAGATAAATT
442551 ATCTTAATGT TATCCTATCC CTCTGATAAC TATGGTTTTT CATTGAAATC
442601 TACTGAAATT AAACACACAC ACACACACAC ACACACACAC CTTTTTAAAA
442651 TACCTCACCA TAGAGAGCAG TATTCTTAAC ATCATAATTA TATGTAAAAA
442701 TTAAGACCCT AGCATTATTC TCTTTCTCTG TGTGTGTGAT GTGTCTGAGT
442751 GTGTTTGTGT GTGTGTGTGT GTGTATTAAG AGTGATATGT CAGAAAGAAA
442801 ACATATTGCT TTATGGGTTA TAATTAGTTA GATATTCCTT ATTCAGTTAA
442851 TTACATTCCC TAATTTTTAG TCACTTTTCT TTTTCATACT CAGTCTTTCA
442901 TTCTCCTTTA ACTCAAGTGA ATACAGCTTG ACTATGAAAG GCACTTTAAA
442951 ATAATATGGG AAGTCAAGAA AAGTTACAAA ACTTTTTATT TTTTTTATTT
443001 TTTTATTCAC TTACTAATAC TGCTTTTCTC CAATAGGCTC TCCAGTAGAG
443051 CCCATTCTTA TAATGAGGGA ACTAAGACAT CATCTGCTCC CAACTTCTCA
443101 GTCCTCCCCT TCAAAACAGT CCAAACCCGC TTCTATTCAT ATCGAAGAGC
443151 AAGTATACCC TTTGTCTTTG TTTGTTTTGT GATGCTATAA CATAATATCT
443201 GAGACTGGGT AATTTATAAG AAACATAAAT TTATTTCTCA CAGTTCTAGA
443251 GGCTGGGAAG ATCAAGGTGC CAATAGGTTT GGTGTCTGGT GAGGGCCCCC
443301 TCCTCATTTC TAACATGGCT CCTTGAATGC CATATCCTCC ACAGAGGAGA
443351 AATGCTATTC CTCACCCAAC AGAAGAGGAG AAAAGCAAAG AGAGGGGAAG
443401 GAGAGGGCCA TACTTGCCTT TTCATAAAGC ACCAATCCCA CCCAAGAGGG
443451 TGTAGCCTTC ATGGCCTAAT GATCTCTTAA GGGTTCCACC TATTAATACT
443501 GTTACAATGA CAATTAAATT TCAAAATGAG GCCGGGCACG GTGGCTCATG
443551 CCTGTAATCC TAGCACTTTG GGAGGACATT CCAACCATAG CACCCTTCTC
443601 TTATCTCTGT TCCCTTCTGT CCTTACCCTT TGTGTTCACA TTCTTAATTT
443651 TTCTTCCTGT GCCCTCTTTT CTCTTCTCCT CCCTACTTTT CCCTCTTTCC
443701 TCTCCTTTTT TTCTCTGCCC AAGCAAGGCA CACTTCCTTC TCTTGCTTCT
443751 TTGTTATTTC ATTATTCTCT TAGTCTGTTT CGGCTATGTG ATAAAAACTA
443801 ATAAACTATG TGGCTTATAA ACAATAGACA TTTATTTCCC ATAGTTTTGG
443851 AAAGCAGGAA GTTCAAGGCC AAGGCTCCAG AAGCTTTGGC ATTGGGTGAG
443901 GTCCTTTTCA GGTTCATAGA CAGTGGTTTT CTCACTGTGT CCTCACATGG
443951 CAGAAGGGTA TGGGAGTTCT CTGGGGTCTC TTTCATAAGG GCAATAATTC
444001 CATTCATGAG GGCTCCACCC CTGATCACCT AATCACCTAA TCACCTCCCA
444051 AAGACCTCAC CTCCTAATAC CATGGCCTTG GAGGTGATTT CAACATATGA
444101 ATTTTGGAAG GACATAAACA TTCAGACTCT AACAGTTATA TTTACCAAAA
444151 TTAGTCCTAA TCAGAGTTAT TTATTTGTGG ATCTGGACTT CCCCCAGTAG
444201 TTTATGAGTC CCTGAAGAAA AGAATTGATT TCAACCCTCA ATCCTTGCCT
444251 AACACAGCTA TTTCCTTTCA ATAACATTCT AGCTGAATTA GTAAAATTCT
444301 CTCTTTGTTC AGAACTCATT CCCAGGAAAT TAAGAAATGA TGCAGCCACT
444351 GTAAAATTAC CTCTAACAAG TTTTTTAAAG GCAGAAAAGA AACAAAGAAA
444401 GCCAGCAAGA CTTTCTGTTT CTACCTGTTC ATAAGAAAGA CCTATACACA
444451 TATGTCCATC AGCTGAGAGA ACATTCTGTT AAGGACAAGA ATGTAAGCTC
444501 TTGAGGGCAA GGATTTACTT TGTTCACTTT CTTATCCTTA GTGCTCAGAG
444551 AGGCCCATAG ATGGTAATTA ATAGATACTG ATTGTTGACC AACTATATGC
444601 CAGGTAATCT TTTAAGTGTT TTGCAAGGAC TAGCTAATTT ACTCCTAACA
444651 ACATATGTTT GAGGAAAATG TTATTATTCT TCCCATTTTA CAGATTAAGA
444701 AACTAAGGCA CAAAAAGGTT AAGTATCTTT ACCAAAATCA CACAGCCAGT
444751 AAGTGGGTGT TAAAACTGGC CATCATACCT TACATCACAG CAGATGTCTC
444801 AGAAAGTCAG TGCTTTCTGC TGATGCTGAT TTTCTAGGTT CCCTGAGGAC
444851 AAACACTTCA TTACTCTCTC ATGTCAATTT TGCATCTGCA AAATGGCAGG
444901 AATAAAACAT ACCTATCTCA CCAGGGTATT GTACAGCTCC CCTAATTATC
444951 AACTGGTAGC TCATTTTGCA AACATGAATC CCCTCATAAC AGTTCATTAT
445001 TCTCACATCC AGTATTTTAA GACACTGTGA CTGTTAAAGT CTTTTTCTCA
445051 AAGTGGTCTT GTTAATTTTT ATCACAGTCA GCAGTTTTTA GATTTTAAGA
445101 AAACTCATCA TGAAAAAGGT AGCATTTCTT ATATCCAGAT GTTCAATAAT
445151 TATTTATATG AAATGATGAA TTAATATAAC CTGCCAGTGT TTCACCTAGT
445201 TCACAGATTA TAGAAAAACT ATCTTTGCTT TTTAATTAAA AATAAATAAT
445251 GTTGTGACAC TGAGGACAGT GTATTATTTA AAAAATATAA GGAGATTTGT
445301 GGAAAGCTTT TCATTATGGG AAATATTTTT ATCAATCAGG GATGATTTAA
445351 AGTAGCCTCT TTTAAAAGAA GGTTGAAGTC TTAGTGTCTT TTCTGAAAGT

FIGURE 3AAAAAA

445401 CGCATACTCC TCAATATCAC ACTTTGCACA ATAAGTCTTT TTTCTTCCTC
445451 CGTAATCCTG TTATTCTACT TTCTCAATAT AGTTTTTCCA CAGATAACAA
445501 CCTAATAATT ATCCCTCATT TTTCTAAAGA TAGATAATCA GTAACATGCA
445551 TCTTTGTTTA AAAATACATG AAGCAATTAT TGTAGCAATA ATCAACATGA
445601 GAAAGAAAAA CAATCTTTCC TTCTTATATG CTGCTCAATA TACATTTCTC
445651 ATTTTCTTTT GTTGTATTTC CTTTACTTAA GTGTTTGCCC AAGGGAGGAA
445701 GAGAATTTTA TCTTTACTTC CAGGAAAGCT ACTCTTACCT CCATCTGTTA
445751 TTTAGGTACA GAAACACATC TTTGTTCTCT GCCTGTCCCT TTCCCTGTGA
445801 CCATCTAATT CATACATTTG TAAACCTTAA TGTAAACTAT CATACAAAGT
445851 TAAATGTCGT TATTACACAA GGAACTAAGA AAAGTGTGAC TGAGGAAAGT
445901 GTATATGGAT CACATGGGGA TCTTGCTGAA ATGCAGATTG TAATATATTT
445951 GATTGGGCGA ATGAGTAGTG TTAGTGGTGG TAACATGAGA TTTTGGGTTC
446001 CTAGCAAACT CCTATGTGAT TCCAGCATTC CTCTGAGTTG TCAGTCTCTA
446051 GAAGCCCTAC TTTTCCTTCA CCTCATTTAA TCGAGTGTTG ATAAAGGGGA
446101 AAATAATCAC AATGCTCTCA ACATAGACGT GAACTTACAT GCTATGTCTC
446151 TATAACTGGC TAGCATCTCT GTAGATTTTA CATGATTTGT AGATGTTGTT
446201 GATCTGTAGG TGTTACATGA CATCAGAACT ACAAGTATTA ATCTGAAGCA
446251 AAATGCAGTA AAGGACCAAG TCAATTTTGG ATACAATTCA GTGTTTACAG
446301 TGGAATCAGC AAGTTTTTTT TTTTTTCATA ATTATTTGTT GCAGTGTCCA
446351 CCACAGAGAA ATTAGATGTG AGCATTTGGT ACTAATTAAA ACAGCATTAC
446401 CTGAAAGAAA ATGGACAGCA AGGGAATTTA CTGATACAAA CACTCATAAA
446451 GGTTTTATAT CCAATTTCCA TGTTGTTCAA TAAACATCAC ATTCTCTGTG
446501 GAAGCTTGTC TGGCTTAGTA AGCCCAGGGA GGACCATAGT GCCTGGAGCA
446551 GAGATTCTCA TGGTAGCAAG ACTCTGACTG GGGCCAATAC TGCATCCACA
446601 GCAGCATCTG TATGGTATAC CCTTATCAAA CAGGAAGAAA CTAAAAATAT
446651 ATTGACAGCA ACATTGCAGA GTCTGCAAAC ACATGAAAAT TACAAATATC
446701 TGCTAACTAT ACCTCTAAAG TGTCTCCTGT TTTATAAAAG TTATTCTATC
446751 TTTGGTTTGG TTTGAAGAAT GTATTTGTTT AAAATTATAG AAGCTGCATT
446801 TAGTGTATTA AAGATTTGTA TATCCAAGAA AGAAAAAAAT AGTTGGTAAA
446851 ACTAAGGACC CTGAATAAAC TTCATTTACA CTTTTGAATA TGCTATAGGG
446901 GAAAAGAAAC ATCTTTCTTT TCTATCTCTA GGCTCATGAC TGAGGTCCTT
446951 ATAAAAACGA ATTAAGAAGA GACAAGCCTA CAAATTTACT TAATGTGAGT
447001 TTTACATAGG CCAGGAGCCT TCAGATATAA AGACCCAAAG AAACAGAGAA
447051 ACCTATGTAT TTTTATGCTT AGATTTGAAC AAAAGTGGAC AGTTGCACGG
447101 AAGTGTGATT AAGCAAAGGG ATATGATCCA GTGGTAATAA ACTCAGGGGG
447151 AGTCGCTTAA CAAGACCTAC TGTTCAGATT ATTTTTTATA TATTTGTGTC
447201 TTTATAGATA AGGATGTTCT TTCCTCTGGG CATAGGGACA GCACCTCTCA
447251 AATGAGGGGC TCTTGACCTG ATTTCAGAGG AGGAGGGCAG GAGAAAGTCA
447301 AAGGGTGATC TTTCTACTTT TGCCGTTTGC TCAAATTCCA TGGTGCCATA
447351 TTTGGGGATA GAATGTTTTG AACCCCATCA ATATCTAAAT TTATAGACTG
447401 AAATAAAGGT TATGACTATC AAAAGTTTAT GTTCTGGTTA CAAGAAAACA
447451 AAACTCTCTT TCCTACTGCT CAGAGGGCTG GAATTCTTTT GGTGGTATGG
447501 AGTCATATTG TAGAATTTCA GTCCCAGCCT GATCTTGTGT ACAACTAGGT
447551 AAGGCTACAT AATTAATCCC ACTTCTGCTA AATTGCTATA TTTCAGTCAG
447601 GCCCAAGTTA CACCTTTAAA TTCAGTTTCA CATTCTAACC TCATATTCAG
447651 TTGCTTCCAT ATTCCTAGTC ATACATTTCT GAATTTGCTT CCTCACCACT
447701 TTTCCTGAAT TCCATGTCTT TATCTCTTTT TCGATGAGGT TGGAATAAAT
447751 AATCTAAGTT GTTATCCAAT TCTGAACTTC CATGACTGCA GAAGCTTATT
447801 TTTCATTTTG TTATGCTTTG CTATACAAGG TGATAGAAAA AATCAAATAA
447851 GACTAAGGAA TGAATGAGAC ATTTGATGTT TTCAGTGAAA ATATTATGTA
447901 TACGTATATA TAAATTAAAA ATGACAGAGA AGTACATAAA AAGATAAGGA
447951 TGAAACAGTA ATTCAATTTC CTCAGCAATC TGGAAATCTA CATATACTAT
448001 CAAGTTTTGC ATTTGTAAGA AAAGAGAAAA AATATAAAGC TATTTTTAAA
448051 TGATTATTTT CTTCTAAAAA ATGTCCACTT TCTGTTAAAG AAACTGTACT
448101 GTTTGGAGGA AAGAAAATAA TACAATGTGG GATATACTTG GGGAGTCCAG
448151 AGGTTATGTT ATCTGCAATG GTAAATTATC AGAGATCACA ATGTCCCTTT
448201 TAAGCATTTG GGCTAATACC CACCAAGAAT CAGTGTAGCT TGGGATTATT
448251 AGTATTTTTC TTTTCTTTGC TTTTCTTTTT TTTAAGAAAA TGCCTTCTGG
448301 GGAGTAACAA GGACATAAAT TCAAAATTCC TCTAAATTTC TGTTGTAGTT
448351 TGGTGAAAAT CAAAGAAACA AAACTCACAG ACACCACTTT TAAAAAATGT
448401 AGCATTGCCA TGAATTCAAA GTGCAGTCAG CCTTCAAAAA ACTACTCTTC
448451 CAGCAAAGAA AAATGTAAAT ATAATGTTCC TACTTTTGAA AGCCTGTAAA
448501 CCAAAAAGTG ACTGAAGCAG GTCTCAACTG ATAGAGGTTT ATTTTGCCAA
448551 GGTTGAGGAT GCGCCTGAGG AAAAAAGTAC AGCCATTGGA GCATCTGTGA
448601 CCTGAGTTTT TTCCAAAGGG GGTTTTGGGA ACTTAAGTAT TTACAGGGGA
448651 AAGAGCAAGC AGGAGGGAGA AAAGGGGAAG GAGGGTAGGA AGTGAGGCAG
448701 ATCGTTACAT TCGTGTGAGG CTCTGATTAG CCCCAATGAA TCTACATTTT
448751 ATGTGTGAAA ACAGGGAGTA AAGGAAAAAG TCAATTTTAC ATTGCCTTGG

FIGURE 3BBBBBB

448801 TTAGTAAATC TACATTTTAC ATAAGATAAA CTAAGCCTTT GAAAAGTGAG
448851 TGCAATGGAA ATGAGGCTAT GATACAAGGT TGTGAAATTA CAGTTCTCTG
448901 TCTGGGAACT AAAGGAAAGC AGTTTTTGCA TGGCTCAGTT CCCAAGCTTT
448951 ACTTTCCCTT TGGCACGGTG AGTTTGGGGT CCTGAGATTA TATTTTCTTT
449001 CACAAGCCAA AAGTACAAGG CAGGCACCTA ATTTACTATC CCCAAATGAT
449051 GAAGGACTAA ATACCTAAAT ACCTAAAGAT AAATCTTACT AGTTTTTAAA
449101 TATAAATTTC AAGATAAGAG CTGCAACTAG ATTATGTTAT CTAACCCTTA
449151 GCAAGTTTTT CCTTGATAAC TGGCCTTACC AAAGAGTTGA CCGAGTCATA
449201 TTCCCTGGAG ACAAATGCAA GATTTGTTCA TTTCAGATGC AATTAAAAAT
449251 GCTACCATAT TTGTGTCTAT TCCTTAAACA ATCATTATTT GGGGCTACAA
449301 GTACAAACAT ACTTACCAAA TCATACATTT ACTTTTTTGC TTCTGATACT
449351 TCTGATACTC TACTGCTACT CCCTTCAATC TGAAAATCTT AATAAGAAAA
449401 TCTATATAAA ATAATGGTCT GATATAGGGT TGAGTTTTGA AATAGGAAAA
449451 TTAAATTGAG AAAGGCCATT TCCCAATAAT TTTTTATATA GATTTGTATT
449501 ACTTAATATA TTCAAATAAA TATCTTAATA AAGGCATGGC TAAACACTGA
449551 GGCATTCCCC TGCTTCAACC AATTCTCCCA ACTCTGATAT TTGGCTCATC
449601 TTTTCTAATT GTTAATCAGT ACACCTCTTT AGAAAGGAAT TTCTTTTAGA
449651 AAATGCCTTA CTTTCTTAAT TTAGATAGGT ACTTAACACC CTCAAGAAAT
449701 GCATCAAACC TTTAAAATTT AGAGAAAAAA TAATTACTAC AAAAGTGCTC
449751 TGATACTTAA ACTATTACAA CGAAACTGTT TTAGTTTATT CCCGCATAGT
449801 AACCGATGTA TAGTAAGCTG CTTCATTTCC CGGCTCTGCT ATTATTATCC
449851 TCATTCCTCA AGGGTAGACT TAAGTGTCTT AGATTCTCAA ATGAAAGGGA
449901 AAAAAACCTA AGTCTGTATT CTGCTTCAAA TAACTAGAAA TAATTATGAG
449951 GCTTCTTTGA CCAGATATAA TTTTTGCCTT GGAGAGTAAA GCAAAGCCCC
450001 TTGCAACAGC CATTATTAAT GACACTGATA TAATTACTAT TTGAAAAAAG
450051 GAAATCTGCC CAGAAAAATC AATTGTAAAC CACCAAATGT TCCTTGGACT
450101 TTTCAGAGAG ATTCTATGCC TATTGTCCCT CATGACCTCT CCATTAAGAG
450151 ACTGGTTGGC TATATTCCTA ATGGTTGCCT TCAATTATTT AGAGAGGACT
450201 TCTAAGCTTT TGTATTTCAT ATTAAAATGG CCTGGAGAGC ATTTTCTGAT
450251 TGACTTACTT GCAGAACAGA AGGGTCACTC TGGGGAAAAC AGAGTAACCT
450301 AGGTGGCTTT GCTCGAAAAA GGTAACTCAG AGTCCTCTTC CATTAGGGCA
450351 GTTTATCATG CAAACATTGA TTCTCATACA ATGAAGCAAA CAGTGTATGA
450401 TGACTTTGCT TTCACTGAAA AATTACAGAA AAAAAAAGAA TAGTTGAAAG
450451 AGTCATTAGG AGTAGTTATC TGTAATCTAA AGCGAGCTTG ATTTGTGCAT
450501 CTGCATTTAT CACCTCTTTT GTTTTTAACT TGCCACATTC TACTTCTCTT
450551 AACATTATTC TCAACATTAG TGGATGAGCG TCCTCTTATA ATCATGCAAT
450601 ATTAATTAGT CTCCAGTTGT AAGAGATGTA TTGGTTTGTA ATTCTGTCTT
450651 ATCTATTCAT TGGACACCTT GAAGCTGGTA AAATTTTCTA AAAGATATAG
450701 TTGAAGGCAA AATTAGAAAT GAAGACAGAC TTTATAAAAT GGCAGAGAAT
450751 ATCCCAGGCA AGATACATGT TGAGATGAGG GTATGAATTT GTGAAAGGAC
450801 AAAACAAACT CAAACTGGTC CTGTGTAATG GTCAAAAACT TGACCATATA
450851 TATCCTTTGA TTTAAAAATA CTACCAGTTT TTTACAGTCT GTATCAGAAG
450901 AGCTTGTTAA AGCACTTGTC TTTGAATTCA GGCATCTGTT TGAAGCAGAT
450951 CACAAAATGG ACATTTCAAA TCACAATTCA TGAACCGTGT CTGATTTCTA
451001 TTCCTTTGAT AAATTAAATG ATCAGTAACA AAATATCTGT AACACATTAA
451051 GCTCCCTGAA AAAATTACTC CAGTGAATTA AAACTCAACA ATATGCCTGC
451101 ATTCTGCATT CAGAAACATT GGTTGAATTT GTTTGTTGAT TTAGTCAATC
451151 GTCTTTTAAA AAGCACTTGA ATTTTTTTTT ACTTGAGTTT TGCTTCAGAA
451201 AAAAATCTAA TTTTGTAATT ATGGAGTTAT ATTGTTTGTT GTCAAAATAA
451251 ATGTTTCTCC ATTTCGCCTA ATTGTCAGAA TTTTTTGGAC CAATTTTTAG
451301 CCCAAGTATT ATAATCTGTG GCATATAAAA ATCTAAAACA CCTACTTGTT
451351 TTTATTATTA CAAATCTACA CTTCACCTTG TACTAATATT TTGTTTTAAT
451401 ATAGAAAAAA AGTAGAAAGA ATAAAAGGAA AGAAAGAGAA GAAACCAAAA
451451 TGAGTTAAAT ACCCCTATGT TCCAGCTCCT GAGCTACATA TTTTTGTGTC
451501 AACCTGACAG CAGATCCAGA ATTATTTCCT TCACACCATG CTGTTTCCTA
451551 AAAATTAAAT CCAAGACTTT TTGGCAATCT AAAGTTATAT TAGAATTTAG
451601 AGTTAAATGA AATGCTATGA TAAAAATCCT TTGTGGATAA AATTTTAAAT
451651 AATTAAAGAG ATGAAACATT TTCATTTTTG GATTAGGCAC TAACCTAAGA
451701 TGGAGAGGTA TTTAATATTA ATAACTGTGA CAAAATGAGA AGATAAGAAG
451751 ATTCTAGGTA AAGGGAACAT AAGTGTGAAA GTCCAAGGTA AGGAACTTGG
451801 CAAGTTGAAG GAAGAGACAG TGTTCTGTGG CTTGAATATA GTAAGGAAGG
451851 AGAGATGAGC CTGAAACAGT GAGCAGAGGA AAGCAAAGTA CACCATTTCT
451901 CTCCTCTTTC CCACATTTAA CAAATATTTA TTGCACACCT ACATGTGTAA
451951 TGTTTAGCAC TACAGATTCA CATTAGGAAT GATATTAAAA TTTTTAAACA
452001 GTATCATATT TGTTTAAATA TGCTTAAGAT ATAATTAACT CATTGAAAAT
452051 TTATTTTCTT TCATGATTAT GAGTATCTTT ATATCTTTCA TCAATATCAT
452101 TTTAACTTTC AGTTATTTTT CCCCAATCCA TCATTCAGGA AACTAATCTA
452151 GAAAAATTGA GTATTTTATA CCTCTCATTC TCTTCTTTCC CTTTTTTAAA

FIGURE 3CCCCCC

452201 GGCTCAGATC AAGGTAAGGC ATTTACAAAT GTCTTTAACA TATTTATAAT
452251 CATAAAATAA TACATTTGAT TCATAAGTTT TATTTCTCAA AATATTAGTT
452301 TGGAATGAAT CCAAAACAAA ATATAACACC ATTTCAAAAG TTAAAATATT
452351 CCAGTCAGCA TATGTCCTTG ATGAAATGTA TTTCTTAAAA CAATTATACT
452401 CCTGATATGT CTTTCATTTC ATTTAAACAT ATATGTCATT TGCTAAGTAA
452451 ATATTTTTCA GGGACAAAAG AGAATTGCAA GTGACTGTAC ACCTTTCTCT
452501 GACCATGTTT GTCTCTCCAT GTTGGGTTCT AAGTCCTGTT GGGAATATAT
452551 CTGATGTATC TTTGGCCTCC CTGGAGAAAA GCGCTTTTCC TGACACACTG
452601 TAATCATTCA ATAAAAATTA GGGAATAAAT GATTGTATGA ATGAACGATT
452651 TCTTACTCCT GAACTCCTAC TTTTTCTTTT TTTAATGGAA AAAAAAGTGC
452701 TATGTCCAAT AGCCTAACTA GAAAGTGACT TATTGGCTTT TATAATAATG
452751 CCAGAGTAGG CATTTTGCAA GGCTCTTTCT TTACAAAGTA GGTAGGTATG
452801 TGTAAAGCAT ACTCTTGATG GTAATTTTGT TTTTACAAAA CTTAAGGGAG
452851 AATTTCAAGG ACTTGCCTTC TCTTGTCCAA AAAAAAAATC TGAGCTTGGA
452901 GGGGAAAGAT GGCTGTCAGT CTGGTGTAGT GAGTTTTCTC TGAGAGCAAA
452951 TTTCAAAGTG CTCTGAGAAC ACTATTGTCA GGATCAGAGT CTTGGGCCAC
453001 TGGCTAGGAG GGAGAATTGA TTCTGCGACT TTGGTGCTGA GCTAAGGTAC
453051 TGAAGGAAAA CTGAAGTAGT ACCATTCTAG CAGCATACAC TGATTTCTTA
453101 TAGACATAGA AGTAAATCCT ATCTAGAGAA AAGCTCTCAA AATATAAGAC
453151 TCAGACACCA CAGATTATGA TCAGGCAATA ATAACACAAT CAAAGACTAC
453201 CAATTACAGA AAAAAACAAA ACATGAGTGA ATGAGGAGAA ACGATCTGCA
453251 ACAGATTTAG TATCCCAAGG ACTTTTGATG CGTTAAAGAA TCATACACAA
453301 AACAACTATG TTTGAAAAGT TTAAAAAATA ATAAATGCAA TCAGGAGATT
453351 GAGAAAAAGA TAAGAAGAAT AAGCAGATTG GGGGAAATTA AACTTATAAA
453401 ATTAAATATA TAATTATAAG AAAAAACTCA ATAAATAGAT ACACAGTCAT
453451 ACACTATATA TATTAATATT TATCAGTATA TACTAATAAA TGATACTAAT
453501 AATTACTAAT GAAAAGACAT TTAAAAAATC TAACAATACT GGACTTCATT
453551 CTAAGAAAAA GAAAACAGAA CAGAGAGCAT ACAATACTTA TATGAATAAT
453601 GGTTGTGAAT TTTCTAGAAG GAAGTATAAC ATGTTCAAAA TAGGAAAAAT
453651 AACACATATC TAGAAACTTT ATTACAGCTG CATAGTATAA AGGGGATAGA
453701 GAAAGGGGAC ATTTTAAAAA TTAGGCATAT AGAAGAAATC ACTGACAAAA
453751 AAACATGACA ACCAGACTTA AAGCAGCTGT CTTACCACAA TAGAAAGTAG
453801 ACAGTTGAAA ATAGTACCCT CACATTTTTC AACCCAGAAT GATATATGCC
453851 AAACTATTTT TTCAAGAATA AGGGTAAAAT ATTGGTGTTT AGAGATAAAC
453901 AAAAAGAGGG AGTTTGTCAC TCAAAGACCT ACCATAAAGA AATGGGCATA
453951 AATAAGAAGG AAAATGATTC CAAAACGATA GTATAAGAAG CAAGATGTGA
454001 ATAAATAAAA TAGTAAACAT GTACATAAAT CTGAAAAAAT ACATGTATAA
454051 AATAGTATCT TTCAAAAGAA ATAAATACAA GATAAAATAG CATGCATGAA
454101 TCAAAGAATA AGTTGTAAAG GAAATTCAAG TACTTCTAAT TAAATGATAA
454151 TGAAAATATT ACATAGCATA GAGTGTGGCA TCCAGTATAT GCAGGTAATA
454201 AATGAACGAG TATAATAAAT GCCCTTATTG GAAAGTAATG AAGTCAAAAA
454251 ATTAATGAAC TAAGTATCTT ACTTAAGAAT TTAACAGGGC CAGGCACTGT
454301 GGCTCACGCC TGTAATCCCA GCACTTTGGC AAGCCAAGGC GGGCGAATCA
454351 CCTGAGTTCG GGAGTTTAAC ACCTGCCTGA CCAGTATGGA GAAACCCCGT
454401 CTCTACTAAA AATACAAAAT TGCGGGGCAT GGTGGCATGT ACCTGTAATC
454451 CCAGCTACTC AGGAGGCTGA GGCAGGAGAA TCGCCTGAAC CCAGGAGGTG
454501 GAAGTTGCGG TGAGCCGAGA TCCTGCCATT GCACTCTAGC CTGGGCAACA
454551 AGAGCAAAAC TCCATCACAA AAAACAAACA AACAAACAAA CAAACAAAAC
454601 AGAAGGGGTC AGGCACGGTG GCTTACGTCT GTAATCCCAG CACTTTGGGA
454651 GGCCGAGGTG GGTGGATCAC CTGAGGCCAG CAGTTCAAGA CCAGCCTGGC
454701 CAACATAGTG GAAACCCCTT CTCTACTGAA AATACAAAAA TCAGCCTGGT
454751 GTGGTGGCAG GCACCTGTAA TCCCAGCTAC TTGGGAGTCT GAGGCAGGAG
454801 AATCGCTTGA ACCTGGGAGG CGGAGGTTGC AGTGAGGTGA GATCTTGCCA
454851 CTACAATCCA GCCTGTGTGA CAGAGTGAGA CTCCCTCTCA CACACACACA
454901 CACACACAAG AATTTAACAG AAGGAATATA AAACAGTAAG TCCAGGGAAA
454951 GTAGGAGGAA AGAAATCATT ACCACAAGAG CAAAAGTGAG AAAATAAAAA
455001 AACAAAGACA AAATAGAGAA AATCAACAAA ACCAAAAATT GAAAAAACTG
455051 ATTGATTACA TAAACCTTTA GAAAGATTGA TCAAAATTTA GGTTTCTAAA
455101 TTCAAGAAAG AAGACACTTA GATGACTGAA GTAATTCAAG TTTCTAAAGG
455151 CTGAGAAACT GGGAAGCCGC TAGAAATCAA CACATGAAAT AACCAAAATG
455201 AAGACAAGAA ACTTCTGTGT ACATTAAAGT AAAAAATGGG TTGTATTACC
455251 AAAAAAAACC TGATTTTTAG AATACAGAGG AAAAGGAAAG GAAAAGCCTT
455301 CTGAAAAATG TCTTTTTTGT TAACTTTACA TGCATTTTTC ATGGGTCAAT
455351 TGATCAACAC TAAATATTAA GTTTGAGAAT CATTTGTTTA TTTGTGTATT
455401 CATTCACTGC ATGTGATAGA TCTATGTGCC AATCTGGGTA TTATAAACAT
455451 CCATAAATCT CTCATATATC ATACTTCAAG TTATAATAAT GTCACTCGTT
455501 CTCTGTGAAC CCTTTGATAC ATCATTCCAT TCAATAAACT GTTTATCCTT
455551 TGATTCTTAA AAAAAAAAAG ATAAAAATTG ACCAAAATAA AAGAAACAAG

FIGURE 3DDDDDD

455601 AAACTAAAAA CTGGGAAGAA AAATGAAGAT ATAGTAACAA ATATTATAGA
455651 GATTGGAAAT ATAATGAATT TTCCAAGATC AAATTTATGT AAATTACATG
455701 TGAAAACTTA CACAAACTAG AAAAAACTTC ATACATATAT TATTTACTAA
455751 ATATGACTAA AAAGGAAATA GAAAACTTGC ATAATTACTT CACTACTAAA
455801 TAATTGGAAT CAGTGGATAA AAACTGTTCC CAACACTAAG AGCATCTGGC
455851 TTAGATGGTT TTTAAGTCAT TTTTTTCCCC CATCTTTCAA GGAACCCATC
455901 ATTTCAAACA TATTCAAGCT TTTCCTAAGA ATGGGGAAAA AAGGAATTTT
455951 CTGAAGTGTG TTCCATAAGG CCAGAATAAC CTCTTAACTG AACGAGGGCA
456001 GTAGGAGAAA TAATAACTAC AGGTAAATCT TACTCAGAAG CATAGGTACA
456051 AAATCCTAAA TTAAATGTAA CCAACCAAAC CAGCTAAGTA TAGAAAAAAA
456101 GACAAACAGA CAAAAAAAAA AAATAGGGCC AAATTTGGAT TTATTTCAGG
456151 AATGCATGAG TATTTTAACA GTAGATAATT TATCAATGTA ACTTAACATT
456201 CAGCAGATAA AAGGAAAAGT TCCAAATAAT CACCTTAATA GATGCAGAAA
456251 AGGCATTTCA TGTATACCAT CTATTCTTGG GTATTATTCT CAGAAATCTA
456301 GTAATATGAG ATAACTTCTT TAACATAATT CAGATCAAGC AAATAGCCGT
456351 CTTAGTGAGG AAATATTACA CTACTTCTCC CAAAACAAGA ACTACATAAA
456401 AATGTCCATT ATCAATAGTT TCTACTAAAT ATTAGAGGAT CTCGCCATTC
456451 CAATGGGATA AAAATAAAAT AAAATAAAAG CATATATGTT GTTAAAAAAA
456501 CCCCACATTA TTCCAGATGA TATGACTCTT TACATAAAAA TTTTTCCCGA
456551 ATGTACATTC AGATTTAAAA AGATTATAGT AAGGTGTCTC GCTCTGCAAA
456601 TTTAAATGCA TTTCTATACG TCAGCATCAA AAGAAAACAC ATTTTAAAGA
456651 AGTTAAATTT ACAATAGCAA CTTAATCTGT AAAGCATTTG AGAATAAATC
456701 TGAAATAGTT TTCAATATGT ACAAAACAAT AATAAAATTT TATAGAAAGA
456751 CATTAAAAAC ACTCAAATAC AGCCCACATT TGTAAATAAG AAAAGCTTAT
456801 CATAGAAAGA TCAATTTTAC CCCAAATGAT GTGCAGCTTT AATGTCTAAT
456851 AAAAATTCTA GCAGATCTCT TTGTGGAAAT CAAAAAACTG ATTTTAAACT
456901 TGATGAGGAA ATGAAAAATA GGGGGCCATG AATAACCAGG ATACTTTTGA
456951 CACAAAATAT GTTGAAGTTA CATGCCTTGG CAGATACTTT AGAGTTACTG
457001 TATAGTGCAT AACATTGTTG CACAATGAGA CAGCAAGACC AATGTATTGT
457051 AACAGAATGT TCAGAAACAG ACTTGCACAT GTGTGGACCT TGAACCTATG
457101 GCAGAAGTGG CACTGCAGAT CATTAAAAAT GTATGGGCTA TTCACTAGGT
457151 AATAGGTACT GGGTAATGTA TATTGGTAGA AAAAAAAAGA AACTAGATTC
457201 CCACCTCATA TCATTCACAA ATTTAAATCC AAGTGTTCTA AGGACAAAAT
457251 GTGATGGAAA GAACTTTAAA ATTTTTGGAA GGAAAATAGA GAACAATTTC
457301 CTTTCTCCTT GCAAGGAAAA TATTTCACAA ATGAAATGCA TATTCTTACC
457351 TTAAAAGAAA AATTGATAAT TTTCATTATA GTCATTTTAA GAATAGTCTC
457401 TCAAAAAAAA AAAAAAAAAA AGAATAGTCT CTCAAAAAAC TTTATTTAGA
457451 TTGTCAAAAG ACAAGACAAA CTGGGAGAAG ATATTTGCCA TGCATACAAT
457501 TAGTAAAGGA GTAGTATCCA AAATACATAA AGAAATCCTG TAAAACTATT
457551 AGAAAAAGAA CAACAAGCCA ATTGAAAACC TTATGTAAGA TCTGTATGTC
457601 AACCTAGGTA AGAAAATACA CTCAACTTCA TTAGTAATAG GGAAACTGCA
457651 ATTCAACAAG AATACTTAAG TATCAAAATA TATACACCCC CAACACTGGA
457701 GTACCCAGAT TCATAAAACA GGTTTTTAGA GACCTCTGAA GAGACTTAGA
457751 TAATCACATA ATAGTGGGAG ATTTCAGTAT TAGACTGATC ATTGAAATAG
457801 AAAACTTGCA AAGATGTTTG AGACGTAAAA TCAGCACTTG ACGAAATGGA
457851 CCTAACAGGT ATCTACAGAG CATCCACTGA ACAACATACA TTATTCTCAG
457901 CTGTACATAG CACATACTCT AAAATCAACC AGAAGTTCAG CCATAAAGCA
457951 ATTCTCAACA AATTACAAAA TCAAAAAAGA AAACTCAGTC ATATATCCCT
458001 GATGAACATA GATGCAAAAT TCCACAACAA AACATTAGCA GAGCAAACAA
458051 GTACCACATC AAATAACTAA TCCACCATGA TCCATTAGGC TTTATTCATG
458101 GGATGCAAGG TTGGTTCAAC ATACACAAAT CAATGTGATT CAGTAAATAA
458151 AACTAAAAAC AAAAACCACA TGATCATCTC AGTAGGTGCA GAAAAGGCTT
458201 TCAGTAAAAT TCAACATCAC TTCAAGTTAA AGACACTCAA CAAACAAGGC
458251 ATTGAAGGAA CATACCTGAA AATAATAAGT GTCATCTATG ACAAAACCAC
458301 AGCCAACATC ACAGTGAATG GGCAAAAGCT GGAAGCCTTT CCCTTGAGAA
458351 CCGGAACAAG ACAAGGATGC CTACTCTAAC CATGCCTATC CAAAATACTA
458401 CTGGAAGTAG CAGCTAGAGT AATCAGGCAA GAGGAAGAAA TGAAAGGCAT
458451 TCAAATAAAA AGAGAGGAAG AAAAACTATC TCTCTTCACA GATGATACAA
458501 TTTTATAGCC AGAAAACCCC ATAATCTTTG CCCAAAAGCT CCTAGATCTG
458551 ATAAAAAATT TCAACAACTT TCAGTATACA AAATCAATGT GAAAAATTGG
458601 TAGCATTTTT ATACATGAAC ATTGTCCAAG ATGAGAGTCA AATCAAGAAT
458651 ACAATTCCAT TTACAAATGC CACTAAAAGA ATAAAATACC TAAGAATACA
458701 TCTAGCCAGG GAGGTGAAAG ATCTCTACAA TGATAAATAT AAAACGCTGC
458751 TCAAAAAAAT TACAGACAAC ACATACAAAT GGAAAAACTA TTCATGTACA
458801 GGATAGAAAG AATTCTTATT ATTAAAATTG CCATACTACC CAAAGCAATC
458851 TACATATTCA ATGCTATTCC TATCAATCTA CCTATGACAT TTTTTACAGA
458901 ATTAGAAAAA ACCTTTCTAA AATTCATATG GAACCAAAAA AGAGACCAAA
458951 TAGCCATAGC TATTCTAATC CTAAGAAAAA AGAACAAAGC TGGAGGCATC

FIGURE 3EEEEEE

459001 ACATTACCTG ACTTCAAACT ATACTATAAG GCTACAATAA CCAAAACAGC
459051 ATGGTACAGA AACAGATACC TAGACTAATG CAACAGGTTA GAGAACCCAG
459101 AAATAAAGCC TCACACCTAT GGCCATCTGA TCTTCTACAA AGTCAACAAA
459151 AACAAGTGAT GGGGAAAGGA CTCTCTATTC AATCAATGAT GCAGAAATAA
459201 CTGGTTAGTC ATATGCAGAA GATTGAAACC GGCCCTCTTC TCTATTAGTC
459251 TCTTCTCAGG CTGCTAATAA ACACATACTT GAGACTGGGT AATTTATAAA
459301 GGAAAGAGGT TTAATGGACT CACAGTCCCA CATGGCTGGT GAGGCCTCAC
459351 AATCATGGTG GAAGGCGAAT GAGGAGCAAA GTTATGTCTT ACATGGCAGC
459401 AGGCAAGAGC AAGTTTGTGC ATAGGAACTC TCATTTATAA AACCATCAGA
459451 TCTCCTGAGA CTTGTTCAGT ACCATGAGAA CAGTATGGGG AAACTGTCCC
459501 CATGATTAAA TTAACTCCAC CTGGCCCCGT CTTTGACACA TGGGGATTAT
459551 TACATGTTAA GGTGAGATTT TGGTGGGGAC ACAGCCAAAC CATATCTTTT
459601 CACCCCTGGC CATTCCCAAA TCTCATATCC ACACATAACA AAATCAATCA
459651 TGCCTTCCCT ACAGTCCCCC AAATCTTAAC TCATTTTAGC ATTAACTCAA
459701 ACGATAATGA TCATAGTCCA AAGTCTTAGC TGAGACAAGG CAAGTCCCTT
459751 CTGCCTATGA GCGTGAAAAA TCAAAAGCAA ATTAGTGGCC ATGCTTGGTG
459801 GTCATGCCTG TAATCCCAGC ATTTTGGAAG GCCAAGGCGG GCAGATTACC
459851 TGAGGTCAGG AGATCAAGAC CAGCCTGGCC AACATAGTGA AACCCCATCT
459901 CTACTAAAAA TACAAAAAAA TTAGCCAGGC ATTGTGGTGG GCACCTGTAA
459951 TCCCAGCTAC TTGGGAGGCT GAGGCAGGAG AATCACTTGA ACCCAGGAGG
460001 CAGAGGTTGC AGTGAGCCGA GACCACGCCA TTGCACTCCA GCTTGGGCAA
460051 TAAGAATGAA ACTCTGTCTC AAAAAAAAAA AAAAAAAAAG CAAGTTAGTT
460101 ACTTCCTAGA TACAATGGGA GTACAAGTGT TGGGTAAATA CACCTGTTCC
460151 ACATGGGAGA AATTGGACAA AATGAAGAGG CTATAGGCCA ATGCAAGTCC
460201 AAAATCAAAC AAGTCAGTAA TTAAATTTTA AAGCTCCCAA AGAATCTCCT
460251 TTGACTCCAT GTCTCATATC CAGGTTATAC TGATGCAAGA GGTGGGCTCC
460301 CATGGCCTTA GGCTGCCCTA CCCCTGTGGC TTTGCAGGGT ACAGCCCCCT
460351 CCTGGCTGCT ATCACAGGCT GGCGTTGAGT GTGTGTGACT TTTCCAGGTG
460401 CATGATGCAA GCTGTCCGTG GATCTGCCGT TCGGGTCTGG AGGACAGCGG
460451 CCCTCTTCTC ACAGCTCCAC TAGGCAGTAC CCCACTGGGG ACTCTGTGTG
460501 GGGGCTCCAA CCCCACATTT TGCTTCCACA TTGCCCTAGC AGAGGTTCTT
460551 CATGAAGGCT TCATCCCTGC AGCACAGCTC TGCCTGGACA TCCAGGTGTT
460601 TCCATATACC CTCTGAAATA TAGGCGGAGG CTCCCAAACC TCTGTGCACC
460651 TGCAGGCTCA ACACTATGTG AAAGCTTCTA AAGTTTGGGG CTTGCACCCC
460701 CACAAAGCCA CAACCCGAGC TTGTACATTG GTCCCTTTTA GCCATGGCTG
460751 GAGTGGCTGG GATGCAGGGC ACCAAGTCCC TAGGCTGTGC ACAGCAGAGG
460801 GGCCCTGGGC CCAGCCATGA AAACATTCTT TTCTCCTAGG CCTCTGGGCC
460851 TGTGATGAGA GGGACTGCCG GGAAGATCTC TGACATGGCC TGGAGACATT
460901 TTCCCCATTG TCTTGGTGAT TAACATTGGG CTGTTCATTA CTTATGCAAA
460951 TTTCTGCAGG AGGCTTGACT TCCTTCCCAG AAAATTGTTT TTTCTTTTCT
461001 ATTGCATTGT CAGGCTGCAA ATTTTCCAAA CTGTTATGCT CTGCTTCCTC
461051 TTGAACACTT TACTGCTTAG AAATTTCTTC TACCAGATAC TCTAAATCAT
461101 CTCTCTCAAG TTCAGAGCTC CACAGATCTC TAGGGCAGGG GCAAAATGCC
461151 TCCAGTTTCT TTGTACAGCA AGAGTGACTT TTACTCCAGT TTCCAAGAAG
461201 TTCCTCATCT CCATCTGAGA CCACTTCAGC CTGGACTTTA TTGTCCACAT
461251 CACCATACAT TTTGATCAAA GCCATTCAAC AAACCTCTAG GAAGTTCCAA
461301 ACTTTCCCAA ATCTTCCTGT CTTCTGAGCC CTCTAAACTT TCCAACCTCT
461351 GCCTGTTACC CAGTTCCAAA GTTGCTTCCA CATTTTCGAG TATCTTTACA
461401 CCATCACCCC ACTACCCCAT ACCAATTTAC TGTATTAGTC TATTCACATG
461451 CTGCTAATAA ACACATAGCC AAGACTGGGT AACTTATAAA GGAAACTTAT
461501 TAACTCACAG TTCCATATAG CTGGGGAGGC CTCACAATCA TGGTGGAAGG
461551 CAAAGGAGAA CCAAATGTAT GTCTTACACA GCAGCAGGCA AGAGCAAGCA
461601 TGTGCAGGGG AACTCCCATT TATGTAACCA TCAAATCTCA CGAGGCTAAT
461651 TCACTACCAC AAGAACAGTA TGGGGGAACC ACCCCCATAA TTCAATTATT
461701 TCCACCTGGC CCTGTCATTG ACATGTGGGG ACTATTACTA TTCAAGGTGA
461751 GGTTTGGGTG GGGACACAGC CAAACCATGT CACCTTCTTT ATACCATATA
461801 CAAAAATAAA CTCAAGATGA ATTAAAGACT TAAATATAAA ACCAAAAACT
461851 ATAACATTCC TAGAAGAAAA CCTAGGAAAT ACCACTCTGG ACATACACCC
461901 TGGCAAAGAT TTTATGAGGA AGCCTCCAAT AGCAATTGCA ACAAAAACAT
461951 TGTCAAGTGG AACATGATTA AACTAAAGAG CTCCTGCCAA CCAAAAGAAA
462001 CTATCAACAG AGTAACTAGA CAACCTACAG AATGGGAGAA TATATTTGCA
462051 AACTGTGCAT CCAACAAAGG TCTAATATCT AGAATCTATA AGGAACTTAC
462101 ACAAATTAAC AGGCGAAAGG CAGCCTCATT AAAAAATGAG CAAAGGACAT
462151 GAACAGATAC TTCTTAAAAG AAGACATACA CATGGCCAAA ATTATATAAA
462201 ATAAGTCATC ATCACTAATC TTTGGGAGAA ATGCAAATCA AAGCCAAAAT
462251 GAGATACTAT CTCACACCAG TCAGAATGGT TATTATTAAA AAGACAAAAA
462301 ATAGCAGATA CTAGCGAGGT TGCAGAGAAA AAGGAACACT TATGCACTGT
462351 TGGTGGGAGT ATAATTAAAT TAGTTACACC TGTGGAAAGC ACTGTGGCGA

FIGURE 3FFFFFF

462401 TTCCTCAAAG AGCTAAAAAC AACTACCATT TGACCCAACA ATCCCATTAT
462451 TGGGTATATA CCCAAAGGAA TATATGTCAT TCTACTATAA AGACACATGC
462501 TTGCTTATGT TCACTGCAGA ACCATTCACA ACAGCAAAGT CATAGAATCA
462551 ATCTAAATGA CCATTAATGG TAGAGTCAGT AAAAAATTAT CATACATATA
462601 CACCATGGAA TACCATGCAG CCATAAAAAA GAATGAGATC ATGGCCTTTC
462651 CAGGAACATG GTTGCAACTG GAGGCCATCA TCCTTTGCAA ACTAATGCAG
462701 GAACAGAAAA CCAAATATTG CATGTTCTCA CTTATAAGTG GGAGCTAAAT
462751 GATGAGAACA CATGGACACA TAGAGGAATA ACAGACACTG GGGCCTACTG
462801 GAGGGTGAAG AGTGGGAGGA GGAAGAGGGC CAGGAAAAGT GACTAATGGG
462851 TACTAGGCTT AATACTTCAG TGATTAAATA ATCTGTACAA CAAACCCCAT
462901 GACACAGGTT TACCTGTGTA ACAAAACTGC ACATGTATCC TTAAAGTAAA
462951 ATTAAAAAAA AAATGTGGTA CATATACACC ATGGAATATG ATGCAGCCAT
463001 TAAAAAAAAC AACAAAACCA TGTCCTTTGC AGCAACAGGG GTGGAACTCA
463051 AGGGCATTAT CCTAAGCCAA TTAATACAGG AGGAGAAAAC CAAATACTGC
463101 ACGTTCTCAC TTATAAGTGG TAGTTAAATG TTGACTATGC ATGACACAAG
463151 GAAGGGAACA ATAGACACTG GGGCCTACTT GAGGGTTGAG GGTGGGGACG
463201 GTGCTGTCTA TGGGGCACTA TGCTGATTAC CTGGGTGATA AAATAATCTA
463251 TACCCCAAAT CCCTGCAACA CACAATTTAT GTAACAAACC TGCACATGTA
463301 TTTCCTGAAC CTAAAATAAA AGTTGGACAG AAAAAAATAT ATGAATAGTG
463351 TATATTAGTG AAATGAATGA ACAGTTGGTA TTGCCCCAAA ATGGTAAGCT
463401 TTAGAAATAT AATTTAGTCC CAGAAGACTA CATATAATAT AAAAATATTT
463451 GTAGAAACCT CAAAAACATA CGAAACTAAA CAATATATTA TTTATGTAGC
463501 TTTAAGGATG TGCTAACTTT TTATTTTTAT AAGTAAGGAA ATGATAAACA
463551 AAATTCATGA TAGTAAATAT CTCTTTGAAA GAGGGAGGAG ACTGGATAGG
463601 GAAGGAACAC AGAAATACAA GTTAAGGAAA CTATTAAATT ACTATATTAA
463651 TGTACAATAT TGCTTATGAT ATTTCAGAAT TTATATCACT TTAGTATATT
463701 TTAAACTAAT ATTTCATGAA GCTTATATCA TGGATCTAGT CTCACTAGAT
463751 GTTTTACCAC TATAGTTACA TGGTCAAATT GATTTGGAAA ATGTAGAATA
463801 TATTTTTATT TCTAGAGTTT CACAGATCAC ATGGGCATAT TAAATGCTCA
463851 GAGAAAACCT AAACTAAGCA ACCTACATAT TTTATTTAAC TGGGTGTTTT
463901 CCAAATACAT TTTCCCTCAG TGGCGACGAG GAGAGTGTTC TCCCTTTAAG
463951 AGAGAGAACG GGCTACAAGG AGGGTCTCCA GCTACCACAG CTTCAAGGAT
464001 TACCTGAAGG TTCACCTGAA AGCCCTCATT CTGCCTGAGA TCCGGGTACT
464051 AGAACCAGAC CTTTCTTGCT GAATACAGAA ATGCTCAAAA GAGCAGTCTC
464101 CTCTTGGGAC TCCTAAATGC CTGGCCAAGA CTTTCTCAGG CTTGCAGTGC
464151 CATCAGAGAC ATTTTCTACC CAATCCTCCT TCTTTAACTC TCTCTTCTCA
464201 CAGGCATCGG GCCTGTATTA TGGTCTGAAA GAGCTTTCTT GCCTCCTCTC
464251 AATTCCTCAC CCCTTTGACT TGGACAGGTG TTTCTTTTCA TAAATACCTT
464301 CTCTTTCAAC ATCATTTAAG GGTTGGCTCC CAAGAAAATC CAGACTTACA
464351 CAAGCCATGA TTTTTTTTTC CATAACAACA CATAATTCTT GGTAATAGTG
464401 TTCCAAGGAA ACGCTTTGGG AAATGATTTA AGCCAAACCT TTCCTGAGTT
464451 TCCAAACTTG ATTTCTGGCA AGTGAGGAAA TTATAGAAAC ATAAATTTGG
464501 GCTTTAGTTC ATCCATACTT TTATAGTAGG AAAATATCAT TTTTAAATTA
464551 TGCATGTATC TTTTTTTCCT TTGAATCCTT TATTCATTTC CTTCAGAATG
464601 AGGGTTATGG AAAATTAATC CCCGGTGGCA GAGTGAATCC CTTAAATTTC
464651 TTTTACCAAA TAATCTTACC ATTCCTATGT ATGGTGTTGT TTATTTCACT
464701 GAAGTATGAA TTTGAAGCAA GTACTCTAAG GAAGAAAAAA TATAACAGTA
464751 AATATATTTT GTTCTTTTTT AAATATCACA TGGTTTTATT TCTTATCTGT
464801 TCTTAATCAG TTTTTATAAG GACCTCAGCC GTGAGCCTAG AGATAGAAAA
464851 GAAAGATGTT TCTTTTCACC TATAGCATAT TCGAAAGTTT AAATGAAGTT
464901 TATTCAGAGT CCTTAGTTTT ACCAATTACT TTTTCCTTTC TTGGATGTAC
464951 AAATCTTTAA TACACTAAAT GCAGCTTCTA TAATTTTAAA CAAATCCATT
465001 CTTCAAACCA AACCAAAGAT AGAATAACTT TTATAAAACA GGAGACACTT
465051 TAGAGGTATA GTTAGTAGAT ATTTGTAATT TTCATGTGTT TGCAGACTCT
465101 GCAATGTTGC TGTCAATATA TTTTTAGTTT CTTCCTATTT GATAAGGGTA
465151 TACCATACAG ATGCTGCTGT GGATGCAGTA TTGGCCCCAG TCAGAGTCTT
465201 GTTACCATGA GAATCTCTGC TCTAGGCACT ATGGCCCTCC GTGGGCTTAC
465251 TAAGCCAGAC AAGCTTCCAA AGAGAATGTG ATGTTTGCTG AACAACATGG
465301 AAATTGGATA TAAAACCTTT ATTTCTTTTT TAAATTAATT TTTAAATATC
465351 ACATAGTTTT ATTTATAAAT GAAATTAAAG AATGAATAAC ATTCATATTC
465401 AAACTGATGA AAAAATTGGC ACAGTAGGTA TATTACATTG GGCATTACTA
465451 AATAGTCTAT GCCTCATGAA TAACTTATAA CCAGAAACAT TTTTGACACC
465501 CTCATTCTTT GTAAATTTCA AAGAATATTT GAAGTGATTT AATGAATATG
465551 GCAACTATGG AAGAAAATAG ATTCAACAAA CTAATACAAT GACAGTTTCT
465601 GATTTTAAAT TAAATACCTA GAAGTGATTT TAGGGGACTA AAATCACTAA
465651 TAATTTTTCC AAGGTCAGCA ACTAAAATTT CAAAAAATAT AAAATATCTT
465701 AGAGTATCAT TTATTCACAC AATGGTCTTA TTAAAGTCTT AGATGACAAA
465751 TACCTCTGCT AGGTACTATA GATTTTTATT GGAATAAGCC TCAAATCCTG

FIGURE 3GGGGGG

```
465801 GAACCTGAAA AAATACCCTA CATTGGAATT CATTTTCAAG TACTTATGAC
465851 TAGAATGTAT TTAGCTTCAA AACTATAATT TGATTTTCAT TCACAATAGT
465901 TAAATAATTC CTTTTGGATG GGCATTTTCA AATCAAGAAG ACTAAATTCA
465951 TTACTTTAAT GAGATAAATT TTAAATGAAC CACTTTTTAT AAAGCATTCA
466001 TATTGGGTAA TTTTTGTAAT GCATTTCTCT TAATGCTTTC AAAATGTCCT
466051 TTCTCAGAAC TCTTGTAAGG GAGGCTGAGT TAACAACCTA TTATTATGTA
466101 CTCCTTACTG AGCTGTTAAT AGCTTTACAG TCTCTCAAAG AACACACCTG
466151 CTGCTCATAA AAACATTTGT GTTGCTACAG AATTTGGCTG TGTTTTAATA
466201 TCACGTATTT GCAGTGACCT TGTAGAATCC GTACTGATTC TATATTTTTA
466251 GGGAAAAAAC AACAATAAAG AACATTGTCC ATTTATTTGA GTATATTAAT
466301 GGAAAATTAT GAAATAATTT GATTAACCTA AGGGTTCTAA TATTTGAAAA
466351 GTTGGTTTTC AATAATGGTT TTAAATTTCT TGGTAATTTT TTACACTATG
466401 TGAGATTGTT TCTATTTTCA TTTTTGAAAG TTTGTTATCT CAATTTATAT
466451 GTGTTGAAAT AGGTTTATTT TCACATATGT GTATATTTTA ATTAGAAACT
466501 GATGGCTTAA ATTCTATTAG AAATATCAAC ATTTCCATAG ATTAATTGAA
466551 AAAAGTAAAA ATTGAAATTA ATGTAGACCT TTTAAAAACT TTAAGTCAAA
466601 AATATCATAA GTCTATAATG AGAGAATGTA AAATTTTAGT TAAGGCAGTA
466651 TTTTTAAAGT TTGTCATGGT TGAATAGAAT ATAAATTAAT TGTTTTTGGC
466701 TAAGTTTCAG TTGGCAAAGG CAAATTGTTC CCCAAACCTG TGTTTGATCC
466751 TTCCATTTCA GACAAGGACA TTTAAAAAAG GCAATCAATG CAATAATTAT
466801 TTCCATATGT CCCTTGATTC GTGTGATTTT TATGGATAAA CCACAGCAGG
466851 TGGATGAAAT CTTTCCATCC TATCTAATTT AGTAATACCT GAATATATAT
466901 AGCTATTACA ACTCCTGTTA TCCACAACTC CTTGGTAATT TTCCTCCTAT
466951 TTATTGAATT ATGCATCACA GCATTTTTCT TTCTCATGTT TAACACGTTT
467001 ATACTTTTAA AAGACCACCA GATAGTTCTT TTCATATTTT AAAAAGATCA
467051 ACAGATGGAC TTAGTTCAAT TGTTGGTTAG CACAGGAATG AAGGGTTTTA
467101 TTGCTGTCCA CCTTCAACAT GGCAAACAGA TAGCGGTACC TGCCAGATGT
467151 ATAGTCCTTC TAAGCTCCTA AAACATGCAA TAATCAATGA TTATTCCAAA
467201 TCACTATTTT TTACTCTTGA ATGTCAAAAT GGTTTCATTG TACCTATGAC
467251 AGCTACATTT ACAACTAGTC AACTGGTCTT ATCTACAGAA ACAGGCAACT
467301 GACTTAAGAC TCAAGTTACT GGCTATATAA AGATACCTCA AGACGTTGAT
467351 GTTATTCCCA CATATAGATC TCAACTGCCA CTTAATTACC TAAAGTGCCA
467401 GACCCCTGGG AATTTTGCTG ACTTATCCTA CTAATTTTCT TGACATGGAA
467451 TTAAAAGGTG GTGGTGTTCT GGGAGATTAA TTTACTAAAC AACAAATGCA
467501 ATTCCATCCA CTAACTCAAG GTATAGTTTA TTATTAAAAT ATTACTTCTT
467551 ACTCAAAGTG ACAAATGTTT TCAGCAACAA CACAAATATC TATTTAATTA
467601 CGTTCACAAC AGCATTGATA ATCATTCTAA CATTTAATGA GGATGTCCCA
467651 GCTTAGAAAT CACTTCACAT GCATTAACAT TCGACTCATT ACAATATTGT
467701 AAGGTGGATA GAACTGACGT TTTATGTTAC TTTTTAACAA AGCATGCTGT
467751 GTCTCAGTAA TAAGATGAAA GGCTTATGTT CACCTGTCTT GTAAGTCACA
467801 GAAAGAAGCA CTGTTTCTTG AAATTCCAAT CCAGTGCTCT TATTAATAAA
467851 GTGTATTAGT CTGTTCTCAT ACTGCTATGA AGATACTACC CAAGACTGGG
467901 TAATTTATAA AGGAATGAGG TTTAATTGAC TCACAGTTCC ACATGGCTGG
467951 CAAGGCCTCA GGAAACTTAC AATCATGTGT AAGGCAAAGA AGAAGCAAGG
468001 ACCTTTTTCC CATGGTGGGA AGAGAGAGAA GAGCCAGAAG CGAATGGGTA
468051 AGAGCCCCTT ATAAAACCAC CATATGTCGT GAGAACTCAC TCACTATCAC
468101 GAGAACAGCA TGTGGGAAAC CACCCCCATG ACCCAATCAC CTCCCACTGG
468151 GTTTCTTCCT TGACATATGG GGATTATAGG GATTACAACA GGAGATGAGA
468201 TTTGGGTGGG ACCACAGAGC CAAACCACAT CATAAAGTCA TTTAGTTTGC
468251 AATATAGAAG ATCCTGTTAG AAACTATAAA AGAATTAGAA ACCTCAGTTT
468301 AAAGCACTGT GAAGCTCATA GTCTTTTCAT CTACGGCATA GATATCCTCC
468351 TAAACTCAGT ATGGTGGTAA AAACTGAAAT GGAAATGCAA ATAAGGAAAA
468401 CTGGTTTGGC CTGTTCTCTA CAATTTGCCT GTTCTCTATA GTTTGCCTTC
468451 ATAGATGAGC ACAGGTATGT AAGTTAATTG TTGTGATAAA AGAAATAAGA
468501 GTTTCGTTCT TCCTAATGAG TCTCTTACCT TACATAGTAA AAAGAGAAGT
468551 GAATATGTGT CTTGAGGTCA TTAGTGTTAT TTGATGAAGA CTCAAAATCT
468601 CATGAAATAC TAACAAAATA TAATCTTTTT AAACCTTAAT TTTTTTTGGA
468651 CATAGGCAAA TCTCATTTTA ATTGCAAAAG ACTTCATTTA CAGCACAGTC
468701 AATAATGAAC CAACAGGAGA GTTGCTGACT TTGGAACATA TGAATATATA
468751 AAAATCCCTT GCAATTCAGG TAGTCGAGAT AATAAGGGCA TGCAAGGAAA
468801 GCAATCCTCA TTTTTCTGAA AAGTTTTACA TTTTAAAAGG TGACTAGGCA
468851 TACTTGGAAG TTCAAAGCAG TAGGATGTAC CTTGCAGGGA AAGAAGGAGG
468901 AAAACCCTTT TGCCATGTTG TTAGAAAAAT GTATATCAAA TATATCCCAA
468951 TTCCATTTGA CAAAGTCAGG TGGATGACCT TCCTTGAACC AGGCTAGGGC
469001 AGAACACTTA GTAAAAGTGG GCCCTGGGTG AGGATGCGAA TCCAGAAGAA
469051 GAGCACCAGA TCCCCTGCAG TACCAAACAT ATCCGTTCCA CCCTCTAACA
469101 CAGAAGAGGC ACGTTGCCCC ATGTCCCTGG ACACGGGATA CATGAGAACA
469151 GTCATCAGAT GGTTACTACC CCCATGGCTT GGTGCTTTCT AATGGTGTTA
```

FIGURE 3HHHHHH

469201 ATTCAGGCCA TGGAGAAAAT CCTTTACCAC CAAACACCTT AAATTTTTAT
469251 GTTAGACTAA GTACTTTGAA TTTCAGAGAT TCTTATACTA TGATTAGAAT
469301 TGTGACATTT CTGTATATGG AATCCATATT ATTATTTCTT ACATCTGTGC
469351 TTCTCAATAT ATTACTGAAA CAGAAAATAT AAAATCTAAC ATAGGTAATA
469401 TGTAAATCAC TTAGTGACAT TTAGCTGTAT TGCAATACCT CACATTGGAA
469451 GCTGCATTGT GTAATAAGTA ACAGCATAGA ATTTAGAGCT AGACTTCCTA
469501 GGTTCAAATC CAAGCCCTAT CAGTAATTTA TTGAGTGATC TTGTCATCTG
469551 TAAGACTTAA TTCATATAGT AGCTTTGAGA ATTTTCTTGG TTTTGAGAGT
469601 TCTTCATGCC TACAACATAG TAAGCAGTAT GAAAGTGTTC ATATTAAAAA
469651 AAAGTTAACT GCAGTATGTC CTGTGTAAAC TTTCAATTGA TTTATTTTGA
469701 CTAATTTGAC ATGTCATTTC AGGCTAAAAA GTCATACGTC CTTCCAAAGA
469751 ACCAGATAAT TGTAGTGTTT ATTTTGGTTA AGTTTTGTGT GTGAAGGCAA
469801 AATAGCATCA GCCAATCTAG TGACAAAAAA ATAGGATCAG TGAACTGTTC
469851 CATATTAAAA TTGAGGACTG TTAAATGCAG AATAATGTTT AATCTTGTTC
469901 CAGGTATCTA TTATTGCATA ATTTTTAAGC CAAAATGTAG TGGCTTAAAA
469951 ATTATAATTC ATAAATATTG TATCTCTTGA ATCTATTAGT CAGGTATTCA
470001 GACAGGACAG AGCAGAGGCA GCTCATCTCT GCTTCACAAT CTGGACCTCA
470051 ACTGGGATGG CGAAACAATG GCTGGTGGCT GGAACACCTG CAGAATGGCT
470101 AGGCATCATC TCATCATACT CTTTCTCTCT CTCTCACCTC TCTTTCTTGC
470151 CCTTCTTCCC ACCCTCCCTA CCCCTTATTC TTGCCATCTC CATCTTTCTA
470201 AGGCTCCTCC TCCACATGAT TATCTTGGGC TTCCACATAG CGTTGCAGTC
470251 TCAGACCAGC CATACATCTT AGATTGCCAT ACAGAGCTCC AAGACAAAAG
470301 TTTAAACTGC CAGTTTTCTT TGAGGCTGGG CCAGGAACTG GCAGCTCATC
470351 ACTTCTACCC TACTTGGTTG GTCAAATCAG TCATATACTA GATCAGATTC
470401 AAGGAAAGGG AGCACAGATT TGACTTGTCA ATGAGAAGAA TGTAATAGAA
470451 TTTACAAACA TCTTTATTTT ACCATGCTGC TTGATTTTAG GCCTTCATAA
470501 TATTACATTA TTTGCTTCGC TTCTCATTTG TAATAATTTA AAAATATGTA
470551 TTTTCAGTAC TGGGTCAAAA CAAATTTATT AATTTTGAAT ATGCATGACA
470601 TCCTAAAAAC TTGAAGTCTA CTTAGTAGTT GTATTTGTAT CTGGAAATAT
470651 TATAGGGTAA AAAATAGTTA ATTCATAAAA GCAAATCAAA AGGTGAGAGA
470701 AAAAATAAAG AACAAAGTTG TGGAAAGAAA ACTTCCACAA ATGAGTTTTT
470751 TCAGTTATTT GAATCTGGAC TATGCATTGA GTTGAGCCAA TGTATTTACA
470801 ACAATCAATA TATACAGATG AAATTATCCA ACTTTGAAAA TGAGATTTCT
470851 GCCTGACCAA GGAAATAGCA TCCATTACTC GCTCCCAGAC CCCTAAATAC
470901 ATAGTCCATA AATATTTAAC ATGGGCAACA TGTGTGACCT CTGCAGAACA
470951 GGGCTCTTCA CTGCCGTGGA GTTATCTTTT ACTCTAAATT TAACTTATGG
471001 CTTCATCCTA GGTATTTTTC TTTCTTTCCA ATTTGATTTT AAAACCAGCT
471051 TAGGTTTATG AGTAGATAAA TTTGTTCACT CTTTGATAAT AATGCAGATT
471101 AACATAATGT TTCTGTAAAA TGACCTTGCT TTGCCTTGAA TTACTCTACT
471151 CGCATTTAAA ACTATCTGCA GATATTTTCA CATTCAAATG TTTAATTTTA
471201 AACACCTTAT TAGAACTACA AAAACCTTTT GTGTGCGAAG GTGTGTACTT
471251 CAGGAAGCTG TCAATTATTA CAATGTATTT ATTAGTATTA TATTACTTAT
471301 AGTCGCTCAG TGATGAGATA TTTAGTTCCC AGTTACAGTA TCTTGACAAG
471351 CCTTTATTTT ATGTTATTTT ATTATAAATC TTGAGGCACA CATTTGATAT
471401 CTTCTGAGGA AATTCAAAAT CAGTGATGAA GTTAGATCAT TATTTGAAAA
471451 CATTGGGTTA TTTAGAGCAT AATAGGATAA TTTTCAAGTC AAGACTATAT
471501 AACTTACTTA TAAAGAATGT TAAAATCTTT ATTTTGGGGA GGAGAAACTG
471551 GATTTCTTGA ATCCTTTGTA GCTTTGTAAA TCAATCTTAA GAGATACCTG
471601 CTTTAGTTTT TGAACAAAAC AAATATATTG GTATCAGATC ACAATTAAGG
471651 CTCACAAACA AATATAAAAA AAATTTAAAG TTCCACCACG GTGACAAAAT
471701 ACATTTAAAT GGGAAAAAGT GAAAAATAAA TAATTAGAAA TTGTTTTTTC
471751 CCCTGTCCTA AATGAGGGTA AGGAATTCTC ATGCTTATAT ATTTAAATGA
471801 ATTTCTGCTG CATTTTCAAT GCAAGAGGCA GCTCTTATAT TACTGTTTTG
471851 TGGCCGATTT GGACAAATGT GTGACTTTAC ATATATTCAC AAATGATACT
471901 GTTTTTCAGT GAAGACATTC TTGCAAAATA ATTTTTCATG TTTTACAGGC
471951 AATTTCACTC TAGTGAAAAT TTACCTTTCT TAGCTTTCTT ATTTACTTTA
472001 ATTCTGTTGG AAACTCTAGC AACCAAAAGA CAGTTTTGGA TGCCAGTCAA
472051 CCAGCATTTG CTCTCTGGTA ATTTCATCTT CAAAGAATTT TTATCTGCTA
472101 CCTTTTATTA CTCTTAATCT GTCCTATAAT CCAGTTAGCA CTACTGTAAA
472151 AAAATCCAAT GCACTATAGT TCTTAGATAA ATTTTATTGT GTATAATTAA
472201 GAGATACAAC AAGTGCATTC AACCCGCGGC CCACACGTGG CCCAGGACGG
472251 CTTTGACTGC AGCCCAATAC AAATTTGTAA ACTTTCTTAA ACATTATGAG
472301 ATTTTTTTTT TTTTTTGCGA TTTTTCTTTT TTTAGCTCAT CAGCTATCAT
472351 TAGTGTTGGT GTATTTTATG TGTGGCCCAA GACAGTTCTT CTTTGTCCAA
472401 TGTGGCCAGG GAAGCCAAAA GATTGGGCAA CCCCTGGTAT ACAACATGAT
472451 GTTATGGAAT ATGCATGATT TTAGAAAGTT ACTATAGTGA AGCAAATTAA
472501 AATATCCATC ATCTAGATTT TTCTTTTTGA AGCATATATT ATTTCCCCCA
472551 CTTTTGTTGT TTTTCAATCC GCATCCCAAA ATTAGATATA ATTAATCAAA

FIGURE 3IIIIII

472601 GGACCATGCA CATGTTGCCT TTCTAGTTTC CCTGCCCCTC CATTCTGCCA
472651 TGTCGTTATA ATGGTTTAAC TTTGAAAATG TTCAGTTTGA CATTTGGAAT
472701 AGCATTTATA TTTGAATAAA TCAACATATG TGTATTAATG TTTCCAAAGA
472751 TACTTAGCGT GTTATTTTCT CTCAGTGGCA TTTGTTGCTA AGTTATGCTA
472801 ACTTTTATCA TCAAAGTTGT TTTTATCTAG CATTTATGTG GCTGTTTTAA
472851 TACTTGACCT AAACTACTGA CATCAGCAGG AATTTGTAAA CTCTTCTAAG
472901 AATGCATAAA CTAAATGTAA TACTCAATTT TTTGGTTGTT GTTTTTGTTT
472951 TTGTAGAAAC GGGGTCTCAC TATATTGCCA AGGCTGGTCT CAAATCCTGG
473001 CCTCAAGTGA TTCTTCTGAC TCTACCTCCC AAGGTGCTGG GATTACAGGT
473051 GTGAGCCACC ACACCCAGCC TCAAATTTTC TTATAATAAA TATATTTTTT
473101 CCTCTCCATT TTCCCCCTTT CAAGTCATTT TATCTATCCT CAGTAGTCCA
473151 ATAAATATGT ATTCTTTAAA TGTTTTGCTC TCTGCTATTT ATATTTCTGA
473201 GTTTTTTCTA TCCGTATATT GTTATTACCA AATTTATGTG TGATTTTAAA
473251 ATTCTAGTAA ATGATCTAAA ACTTTAAGAA TGAATGACAA ATTTAAAGTT
473301 GTTGTTTGAC TATAATATAC TTTTAACAAA TACTATTAAG AAATGTTGGA
473351 ATGAAGGCAT TTTCTTCAGG GCCAAGTATC AAACTTTAAA CACTTAATTT
473401 TTAGTTGAAC ATCATTGTAA ATATTTATAG AGTGGTAAAG CACAGAAGAA
473451 AAATCTGTAT CTCATCTATC TACAGGTAGG CTACATGAAG ACAGACGGGA
473501 AAGTTAAAAC TGAATAAATA TCAAGAATAT GTATTAAAAG ATATTTCAGC
473551 ACAAATCTTA GTTTCTGTAT AGCATACTGT TTTGTAAAAT ATTTTTGGCA
473601 AGTAAAATCT TGGACATTCT CCACAATGTT CCTAAGAAAA CAAGTATGCT
473651 ATACTGACAT AATATTATTA CATTTAGGTT GTAGAAGCAC TATATGCTAG
473701 CAAAAGTAAT TTTTCTCATC TCCCATTTGA ATTGTCATTA ATTTATGCCA
473751 ACAAACTTTT AATTGCTCTA ATAATATTTA AGAATTTAAA AGCTAAGCTT
473801 ATGGAGCAAT TAATTCATTT TTTAATTCAA TCATTTGGAC AATATATCAT
473851 GAGAGCCTAC AATATGCTAG GCATACTGTA TTAAGTAGTT GGAATATAAA
473901 GGTTAAAAAG CAAGTAAACA CAACATTTTT TAAGACTTGT CACAGCATCT
473951 GCAAGATGAC CTTAAGGCAT GAGCCTATCA TTGCCCTGGA ATAAATGCAC
474001 CACCCATTGA TAGTTACTCT TAAAAGAAAG AAACAATGCT ACGTTACACA
474051 CCTGCTGGAT CCTGTAAAAC AGTTTTACAT ATTATTTTGG TTTATCTTAC
474101 AACAAGCTTG ACCCTTTGAT ATAGGTATAA CCTTTCCAGT TTTCATAGAT
474151 GAACTGACTA CAACTAGGAC TCTATTGGTC TCATTCTAGC ACCAGTATTT
474201 TCAAAAGATC ACACTTTAAT AATTAGGCCA TTTTCTCTAA CAGTAAATAT
474251 CACTATTAAA AGCAGTTCGT TATCTATATA TGTTATCTAT TTTATTAAAA
474301 TCAATTACGA ATGTTTAATT CCAGATCAAT ATTCCTCTAT CATCAGTGTA
474351 CTTCTGTGCC TTCTCCTACT ACTGTTCAAT ATTTAATGTT CAGGAATGCA
474401 TTAAATATTC ATTTTAGGTG AAACAAGGTA CACATTGGTA GGAATATATG
474451 AAAATAGTCA TGAATGCATT TCAAAGTGAT TTGGGGTTAT CTGTAATTTT
474501 GGATTACTGG GAATAATCAA GAGTTGATTG TAGTAAATTA TAGTAGTAGA
474551 ATACTTAATG ATACGTCCCC AGAAATGCAG TCAAAAAGTA GTTGTGTACA
474601 TGGAATAACT ACTTCTACAT TTTTCTTACT TATACATATT TTGCAATTTT
474651 GCCACAACAG TGGCTAATTT TTACCTAAGA AAAACATTTT AGAGCACCTT
474701 ACCCACTAGC TTAAACCACC AAGGAACTTC TTAACCCTTT CTACTCACCC
474751 CTCACCATTA GAAATTTCTT CTTGTGCATT TTAATGAATG CGAGAAAAGA
474801 CAACAACTCT GTTGGTTGCC AACAACAGAA CCCAGCTGCC ACTACTATTT
474851 AATGTTGTCA CAATGGAGAA TCCAAGGCAG AGTGGAACTT CCCAGCCTCA
474901 GAAAGGCAGA AACCAGGAAA GCTAAGGTTG TTCAACTTCA GTGATGTTTC
474951 TTTGTCATGG GTTCAGTGAA GTTTCTCATC ATGGGTTCAT TTACTTAGGA
475001 AAAGAATTAT ATAGTTATTC TAGCTTGCTC TTGTTTCTGG GACAGTTGGC
475051 CAGCCCCATC TTACATTACT GGTAGATTAT AGTTAGATCT GGTTATAGGA
475101 GAATCAGTGT GAGCTGAAAG GTATCCTAAT GTGTGTCGCT ATGTCAAAGC
475151 AGAAATTTTA GTAGTTCAAT TCCCAGTGAT ATGTGACCAG AGCTGCAGTA
475201 GGTACACCTT ATGTTAAATG GTTTAGCGAT TCCTTTGTGG ATATCAATCA
475251 ATTGACATTA CTAAATACTG ACTATGCATC CAGCACTCCT TTGTTTCATT
475301 TTGTTTTGTT TTTTGAGGGA AATGTAAACT ACATTTTTCA GGAAATTGCA
475351 GCCCACTTTA GGATACATAC GGATGCACAT TCAATAAGTA GAGGAGGGGA
475401 CCAAATCGTA TAAAATTAAG TGCTAAATGC TGGTTAGAAT CAAAGAATTT
475451 AAAGATTAAT TTATTTAAGA TGTCTAATTT CCTTACTGTG TAATACCTTT
475501 AAAATATTCA AATGCCAGTC TTTTACTTCC TTGGACAGTT TTAATCTGTT
475551 GGAAATATAA GGCCAAATTG AGAAATATAT AGTCATATTA GAAGATTATA
475601 AAACATCTTA CAGGCACTCT CTAATGAAGA ATTTTCTAAA GAGTTTGATT
475651 TCCTCAATTG ATATAGCATA TTGCTCCTAA AATTCTGAAA TTTTACTAAT
475701 TATTTTTAAA CACTTAAAAG CATTCATACA TATTGATCTT ATATCAGGAC
475751 AAAAAAATTT CAACAAATTT CCTGTAGCAG AAATAATTAT TTGCAAACCA
475801 TTAACAAAAT CAGAGAAATT AAAAAAAACC CACCACATCT CCAATCTATT
475851 TATTTTAAAA ATTTTAATTT TATATTAAAT AATATATTAA AGCATAATAG
475901 ACAAATTATG AACTATTTAA AATGAAAGAC ATTAAGATCC TCACATATCT
475951 AAAACTGTGA AATGTGACCA ATGCAGAAAA ATAAATTAGA AGGAATGAGC

FIGURE 3JJJJJJ

476001 AAGTGTAAAA TCAAAAATTA ATGAAATAGA ATCACTAATA TTTGATTTGA
476051 AAATCAAAAG CCAGTGTTTT TAAAAGATTG ATCAAATAAA CAAGCTTACC
476101 TAAAAATAAT AGGAAATGTT ATTTACGTAT GGAAGAGATT TTTAATAAGA
476151 CAAGACTAGA TGTAAATATA TATCAATAAA TATAAAGGAA ATATAATAAT
476201 TTTACGGTAA TTATCAAAAC TGAATAAGGA GAAGATTTGA ATATAGCGTA
476251 AAATAATTTT AAATGATAGT CAAGTGTGTA CTACCAACAT GGTCCATTTC
476301 AATTAAGTTT TCAAAGAGCA GATAATTCCC ATGTTGTGTC AGTTATTGCA
476351 GAACATTAAT AAGTGGAAAG TTTCACAATC CGTTCTCTAA ATATAGTATA
476401 ACCCAAATAT CGTGAGATTG AAAAAGAAAA CTGTAAGCTG AGATAACTTA
476451 TAAGTATATG CTTAAAAATT TTAGCCTGAA ATATTACCAT ATTGAATTCA
476501 AAATTACAAT AAAAATTCTA ATATATTATG AACAAGTGTT AACAGGAAGG
476551 GTTTATCTTA GGAATGCAAA GATAGTTCTG CCTAAGTATA TACTTTATTG
476601 AGAAAAACAT AAAATTCACT TGGCAACAGA TAAATTGTTT TATAACATCC
476651 ATAATTCATT TCACATTTTA AAAACAAAAT ACAGACAAAC AAAACTACAA
476701 TGGAAGAAGA AAACGTCCTC AACTAGACAT CTGCCAAAAA TGTAAGTCAG
476751 ACATAATTAT ATTTAACCAT AACACAATTA GAATCTGTTT GATTAAAGAA
476801 GAAAAGAAAA AGTTTCTGTT TTTACTGTTA CTTTGCAATA TTATGCTAAA
476851 GCATTGCAAT AAGAAAAAAA ATACATAAGA AATTGTTTTT GGTTTGCACA
476901 GTAAAATATT ATAGATGAAG TTATATAGGT CTTACATACT TTTTGTGATA
476951 TATTTAGGTA TTATAAGGTT TCTGTTACTA TAGTGACTAA AATATTTAAA
477001 ATGTAATTAT AAGTGGTCAT TGCTAGTATA CAGGAAAACC ACTGATAATT
477051 GCATGTTCAC TATGTAACTG ACTTCTCTTG ATTAATTCTA AAATTTTTTT
477101 AAGTTAATTC TCTCGGAGTT TCTAAGTAAA CATTTCTAAC TAACAGAGAG
477151 AAAATGATGA TTTATTTCAT TCAACCTTTA GGAGAGACAT TTTCTACATA
477201 TATTAAAAAA CTGTTATTTT TAAGTTTTGT AAGATAATTA AGTTATGCTT
477251 TACAAAGAAA GAACATATAC TTTATGATTT GGCTAGAGTA GAATAAGATT
477301 TTCTCCAACT AGCTTTAAAA AAAGGAGTAG ATTAAAACTT CGGATGAATC
477351 AAGGCAACTT AGAAACAAGA ATAGAAATGG ATGACTTTTT ATGACTATAA
477401 GCTCTTTTAT CATTATTCCT ATTTTACAGA AGTGGTATAA CTCAGTTCCT
477451 GGGTTCACAC ATAACTCATT CTGGTACTCT ATTTTGTACA TCTTGAACTG
477501 GAGTGCACTC AGAGTTGGTA ACTATTCAGG AATTGATTTA TTCTAATTAA
477551 ATGCTAAAAG AGACTGAAGA GGGCTGGGCA TGGTGGTTCA CAGCTGTAAT
477601 CACAGCACTT TTGGGAGGCC AAGGCGAGTG GACCACTTGA GGCCAGGAGT
477651 TCAAGACCAG CCTGGCCAAC ATGGTGAAAC CCCGTTTCTA CTAAAAATAC
477701 AAAAATTAGC CAAGTGTGGT GGCACGTGCC TGTAGTCACA GCTACTCGGG
477751 AGGCTGAGGC AGAAGAATCG CTTGAACCAC AGAGGTTCAG ATCACACCAC
477801 TGCACTCCAG CCTGGTTGAC AGGACGAGAC TCTGCCTCAA AAAGAGAGAG
477851 AGAGAGAGAC TGAAGAACAA ACCAGAATAT TCACGTATTA AATATACAGA
477901 AGTCTGCCCT TTCCAAGAAC AAATATATTT ATGTTTGCCC CTACAGAGCT
477951 TGAGAATCCA CATTAGTAAT CAGAAGATTG CAACATTAAA GTAGAAATAT
478001 GAAAAATATT AAGGACTCTT TCAGCCAGAA TATGATGACT ATGTGTACCC
478051 AGGTAGAACT CATTTTTAAA AGGGTCAGCA AAATAAAGTC CACGGGGTTC
478101 AGTGTCTATT TCCTTTGGAA AGTAATTGTT AAAGGCTGAC CAAATCTAGT
478151 ATTCAAACTT TTCTTTTCCC AGAGCCATGT GAAATATCTT CCTTTCATTC
478201 AAGTAAAAGA CTTTCAGCTT TGCTAATGCC ATAGTTCAGG CAATAAGATT
478251 TTTTGATAGC CTTTCTAACT TTAGGTTCCT AGGCCCTGCA ATTCTTGATT
478301 TATCCAGGCA AAATACCTTT CTGCAGATAA TAAATCATGT TCTAAATGTG
478351 GTTTTAATTC GTTTATTTTT GTTTATTTTG AGAGGATTAT CCTGGAAACA
478401 TCTCCACAGT TTGATGAATG TGAGTGTGTA CATTTGTGAG TGTGACAGAG
478451 AGGCAGGGTG AGGAAGTCAA ACAGAAACGG AGAGAGAAAG GATGTAAATG
478501 ACTTAGATGA CTTCTAGTGG AACCATTAAT ATCCTTTTTT ATATTATTTT
478551 GTTTCTCAAA CAACCTGTAG CTTCAGTCCT CTAGCCAGTA GAACAAGAGC
478601 TTTACCACTG TCTTAATTAA GACATCGCAA AAAAAAAAAA AAAAAAAAGA
478651 TTTGGATAGT AGAGTACTAC ATATTAATAG CACTTGGACC TATTCCTGCA
478701 CTTGCACCTA TATTTTCAAA TCGGTATGAC TTAAAGCCAA GAAGTTATCT
478751 TTACACATCA AAACTTCTAA AAGAGTCTCC TGGACTTTAT TAAACAAATT
478801 CTATTCCCAG GCTTGAACGA GAATACTGTA TATTCCATGC AAGACTGGGT
478851 GATTTATTTG CCTCCTATAT TACTTAATAT CTGCCTATAT GACATAAAAT
478901 TAATAGAAAA TAAAAATAAA GGCAGCCTGC ATGGATTTGT TAACCTTAAT
478951 AGAAAATAAT TTTACCTTTG AAATGTGTAT TTAAACATTT GGTGTTGAGA
479001 ATTTTTTCTT CCAATTGAGG AACTAGTTGT TCATATAAAC ATAGTCTAAT
479051 GATTAGCCAA CAAATCATTA CTATGTGGTC CATAAGGTGT GTTAGTTACT
479101 TCTAGTGTAT AGATAGTTAA GAACATAAAG TGTGGAAAAA ACTACTTTGG
479151 CTCAGTCTAA TCCATAGACA TATATACTCT GGACATATTT GCTTAAATGG
479201 GGTGTAGTGG AAAAAGCACA ACTTCGATGG AAGCCACTGA CAAGTTGTGT
479251 GACTTGTTTT GCTAATTTAC TTATTCTTTC TGGACTAATT TGATCATAGA
479301 TAAATGGAAA TAAAAATATT ACCAGTTCTT ATTTCACAAG ACTATTATGA
479351 AGATTAGATT TTAGATGTGT ATGAAAACAC CTTGTAAATT GTAAAGCTCT

FIGURE 3KKKKKK

479401 ACATAAATCA TTGTTATTAT GATTGTTGTT ATATCTTTAC ATAGATATGT
479451 CTAGAAAATA AAATATAATT TTTATCTTAC ATTTAATCCA ATTAATTTAA
479501 AATTAAAAAT AAAACAAAGA GGTGACACCT TTTAGAAATC CCAATAGGCC
479551 CAAAGACTTT AGGAGAAAGC AAACCAGCTA AAAGATGACC ACTATGCTGG
479601 CCTATTGAAT CTATTCCCAT AAATGGAAAT GGTAAACCCA AGAGAGGGAG
479651 ATGAGGAATG ATGACAATGA TTCATAGCAG AAGGAAAAAC ACCTGCATTT
479701 CTGACATTAA AAAAATATTG AATTGAATTG CTAGGTAGAA CGTTGGTGAT
479751 TACGTAAGCT ACACCTAACA AAGTGTTCTA GAACCTTATA CATACCATGA
479801 GATTCAATGA ATGTCTGTAG AATGAATGAG TCTTCTAGAG GAGTAAATCA
479851 AAACCTAAAA GGTAATTTGC CAGGGTACAT AATAGAAGCA GAATCAAGAT
479901 AATATCCAAG ACAGGAGAAC TCTAACCTAG AATTTTTTCC ATGCTGTCTT
479951 CTATTGATAC AGGCCCTGTT ATCTCTGACT GTAGAAAGAT ATAGCCATAG
480001 GGTCTGAACA CCTGAGCCTA TTTGTTTTCA CCAAGTTATA GTTTTCAGAT
480051 TGAATGCTAA CAGGTTCCAG ACTCTAGCAA GAGGGTCCAT TTTAGTTACC
480101 ATGAAAAGTT GACACCTATA AAGCTAAGTT CAGTATTTCA GGTAAACGAA
480151 AGATTCAGTG TGACAGTATG ATTCCCAGAA AAGCCTTGAT TCTCAGCATC
480201 TTGGAAGGAG CAGTGCCTAA ATATAAGTGC CAGGGTCTTC CCATGGGAAG
480251 AGAACCATAG GTAAAAGTCA ACATCTCTAG AGAACAGTAT ATGCCTGCCC
480301 TGTTTGACAG TGCTCTACGT TCACACTATT TGGTTCCAAA CTATTTTTTT
480351 TTAATTTGGA TACAAATATG TCAAACAGGA ATTGTATGTA TGTTTTATTT
480401 TAGAAAATGA TACAACTTAA AATGTGTTAA AGTTCATTGC TTCTCAATGA
480451 TTTTTTCTCA CAATTGGTGC TATTTTCTGT GCTCATCCGA GGAGAGGTCA
480501 TGCAACAAGC TGATTCACTT TCAGCCGACA AGCATTAGTG CACAAGATGG
480551 CCAGTGCTCT CAGCCAATGA GCATCCACTG CACTATTCAC AGTTGAGTAT
480601 GCTTTGCAAC CCACGCAACT ATGCCTTTGG AGGTTCACTT TATGCCATTT
480651 ATTTACTCCC TGATACCATG TCTTAATCCA CAAAAATGTG CAAGTAATAG
480701 TTCTTGGTCT CCCACAAAGA ATTTTTTAAA TCATACTTTT AGATATTAAT
480751 AAGTACTTAG AACTAATTAA TAATACCTTG TATGAAAACT TATGAAGTAT
480801 AACTATAGCA GTACTTAGCA TGAAATTTGT AAGCTTAAAT TATATATTTG
480851 AAAGAATGTG CTGATAATGA GTTAAGCATG AAGCATAAGA AGTTAGAAGA
480901 CAACATATCT AACAGAAAGT ACAAAGAAGA AAGAAAATTT ATAGTAAGAA
480951 CAGATATCAA ATGTAATAGA TTAAAAAAAA ATAGAGGGGA AAAAGCCAAA
481001 AATGTGTTCA AACCTCTGGA AAGCTTGATC ATGAAAAAAA GAAATTATAA
481051 AAATAAATAA TATTAAGAAT GAGAAGAGGA ATTTTATCAC ACATTCAGCA
481101 AAGATGAAAA ACAGAACTTT ATGAACAATG GAACGTGTTC CCTAGCTAAG
481151 TTGAAGATTT ACGTGTCATA CAGCTAGCAA TGCCATCATG GTACAAACTC
481201 CAGAAAAGCA CGCCAACATA CCCTATCTAA ACATATTCAA AATTCAACCT
481251 GCCAGGATGA AGAAAACATC TCAATGGCTC TGTGGCAAAG CCTGGTCGCT
481301 ACCTGGTGAC AACACCTTTG AAATGGAGTT GATGCGTCAG CAGAAAGGCA
481351 ACTGGCCAAA ATTCTGGGAC GATAGTGTCC TACCTATGCA TATCATAGAC
481401 AAAAGCTAAC TTGGTTTCCC AAGAGCTTAA AAACACCAGG AGGAGAGAGG
481451 TCTGCTGTGT ACTGTGAAGA ATTCTTGTGA CTGCTTCTTC CTGGACCCTC
481501 TTCCTCATCA TGTCAGCAAG CTGTAAGACG TAAGACAAGG CAGCAGCACT
481551 CACCGGTAGT GAGTGATTCG GGCTGAAGAA CCCCTTAAGT ACACTTCCTA
481601 CTGTTTGATT TTTATTCCAA GGATTTAGCT ACAGGTACAC TTTTGTAGGT
481651 AACAACAAAA ATACTAAAAG CTGCCTGCAA AAGGTGTCCT TTATTCCCTG
481701 TAACTTTACT GAATAGGAAG TTACTATTTA GCTATGTTTT GGGGAAGCAA
481751 CAAGGATAAG ATATGTAATT ATCCTGGAGC CATTCTAAGA GTAAACTTTT
481801 GAACCATATC TTCTCTCTTT TGGGATGAGA CTAAATGCTT TTTTTCATTG
481851 CTTTAAAGTT CTTATCTCAG TCATCATTTC ACACTGTGAG ACAGCACTCA
481901 AAATGCACCA TAACTCTTAC GTTGTAGAAA TTCTGTGAAA AGTAACATAT
481951 CCTCCTCTTG TATATGAGAT TGAAAAATCC AAATGTTCTA GAAATTCCTG
482001 CCAGAAACAA TATCTTTTTT TCTAATAGTT CACAAGTATT TTTTCTCCAC
482051 AATATGTGTT TTAAGCCACC TAATTATAAA GGCCTTGATA TGAGCAAGCT
482101 CCTACATTTA ATCCCTAACA GCTCACTGTC ACCATCGATG ATTTATAGAC
482151 TTTATTTCCT TGTATTTTAT GCTAGGTTGA TAAATAATTA TTTACTTTCT
482201 AATCTTAAAA TCACCTAGAG ATAAATATAA GTTGCAGTTT TTTGGTTTAG
482251 TCTTTTTTTA TTTAAAATGT TGCTGTTCTT AATTCAATTT TTTTCCTTGT
482301 ACTTTATGTT TAATAAGCAG TTTTATTATT TGGGGTATAA ATGGCAAATT
482351 CAATTCTTTA GCTAGACACA GAATAACCAA ATAGCATATA AAGTTCTGAC
482401 AAGGAAGGTC ATAAAGTTTA AAAATGATCC TTAAGATAAG ACTTTTTTCT
482451 GAAAAGTAGC TTAAGAGAAA TGATTTTCAT AGTTCTAAAT CTTAAAGCAT
482501 CACCAGCAAA TACATGAAGT TTGACCTATT CTCCATATGT GTACATTTTC
482551 ATAACTTGTC TTGCTAGTTG GGAAGGTCTC CTAAATAACA GTGGTTTTCA
482601 GGCAAACACT AAATGAAATT TTGATGGGAA TATTATAGAC AGAATTTAAG
482651 CATCAAATGA ATGATTCAAC TAGTGACCTT GAAAGTCATT TTGCATCTCT
482701 GAAAATCTCT AGGGTTTTTA TGAGGATGGT GGAAATTAAC TTGAGGGCCT
482751 GTTGACCTAG CTTGACCTAT GACTTTTGTT TACACAAATG CATTTTTTTC

FIGURE 3LLLLLL

482801 CAGATACCCT ATTAAAATAT CATTGTAAAG TTATTGAATA ATAACACCAT
482851 ACAAAAACAG TGTAGGTTTA ATTTGTCCCC ACCACCAGCA TATTGTGGAC
482901 AATCTCTTAC ATGGACAGGT AAAATGAACT GTCCTGTTCT GAGATAGTGG
482951 GCAAGAGAGA CCATGTAACA AACCCTGACT GTCTAGATCA TCCAGAATGC
483001 CCTGGCAAGT TCACTTCCAT TTAGTGAAGT GAGATAATTT GGCAATTCAC
483051 GCAAGAGACT GAGAACCAAG CCTCAAGCCC TGCCTCTGAT TCTGCAGGTA
483101 TGGTAAGTCT TTCATGCCTT TCTGTGTTTC CAGTGCTTCT TCATGGGCAG
483151 ATTATTTTTA AATCTACTTC ACAGTCACTA TGTAACTAGT ATATGTTTAA
483201 AAATAAGCTA TATTTAGGGG AGGAGTCAAT TCTCCCTTAC AGGAAAAAAT
483251 TCATTATTTT ATTTCCTAAA TTTTATTCAA CTTCAGGTTT TACTACTGGG
483301 GAAACACTGA ATTACAGCAC AAAGTGAATG ACTTCAGGAT AAAAGATTTC
483351 AAACTTTAAA AAGCAATTAA TTTATTTCTC CTTTCACCCA CAGGTCTACC
483401 CACGGATAGC GCCGGCATTT TGGCACTACC TGCGGGTAGA AGTGAGTAGC
483451 TGGTACTTGA ATTCTCCCAC CTTTGCTCCT TGCACTCTGC TGGTGTGCCC
483501 ATTTTGCTCA AGATGCAGCT GCCATTCTGT GTAAACATAT TCTCACACCA
483551 CCATCATTTC TTACAGTTGG GTCAGGAATC TAAATCACCA AAAATACAAG
483601 TGCAGTTTAT ATAAGACTAA TCATCTTTCT TAATAAATTT CCAAATAGGA
483651 CCATATCATA TGCATCATTA TGATAAACAG CTAAATGCCA AATTATGGAA
483701 AACCATGCTA ACACTACTTT GTAATCAATA CTTTTGGTAT TCAGAGCATA
483751 ATTTCTCAGT TAAACTTTGG AATGTTTCTA GGAAAAGGTA GAATAACTCT
483801 GTTTCATTTC CTTTCTCCTT TTTTTCTGTC CCCCAGGAAC ATGAGCAGCT
483851 GACCTACTCT TCCACAAGGT CCAAAGCCCC CAGTGTCATC ATCACAGGTC
483901 TTAAGCCAGC CACCAAATAT GTATTTCACA TCCGAGTGAG AACTGCGACA
483951 GGATACAGTG GCTACAGTCA GAAATTTGAA TTTGAAACAG GAGATGAAAG
484001 TAAGTTTCAC ACAAGGATAT AACATAAGAT GTGAATTTAG TATCATTCCA
484051 ATTTGACCTG ATATTTTAAA ACCAGGTGTC CCAAGTTTTT AATAGCTTGT
484101 TTAAATGAGA TTTTGTTCAT GTAAATACTC ATACAGTCAT TTCAGTTAAT
484151 ATTTGTTGCT ATCATTAAAT GCTTTCATGA AATGCCTTAC TCTACCATAA
484201 AAGTAATGTG GCCAAAATGT GGCCCTTTAT GCTATTACAC AGAGTCTCTG
484251 TGGATGCCTA ATAGTTCACC AGTCCTGGCA TCATGATATG ATCCTAATGA
484301 AAACTTGGGA GAGAATAAAG CCGTGAACAA ATGGTTTAAG CAATTCAGAA
484351 TTGTGCAGCT TTGGCCTTTT ATCTCAGTCA ATAAAAATAG TGGTCAGGAG
484401 ATGAACACCA CTGACATGCA CATTATAGGT TTAAATACAG ATGCATGGGC
484451 TTCATCAGAA ACCCACATTA ATTCCGGGAC CTCAACATGC TGAAAACCAA
484501 AATGGGAGAT GAAGGGAGTG AGATATTCCA ATGTCATGTA ACATCAGCTT
484551 TGAGGTCTTT TATTCATTCT AAACCCAGCT TTACCAATGA ACTCTTTTTG
484601 GCCTTCAGAA ATCCATCTTA CTGCTCTCTT TGTGAGAATA GTAGGGATTG
484651 CTTTTGCCAG ACATCTTTAT GAAAAAGTGG TCAAATATAT AAGAAAAATC
484701 TGTTTCCATC ATTGTTAACA TACTGTATTA ATATAATAAT TCAATAAAAG
484751 TAAATTTATT ATAGTAATTC CTTATGGATA ACAATAATAA TAGCAAGCAT
484801 TTATTGAGAC CCTAAAAATG CCTAAAATGA CATTAAATAT TTTACATGGA
484851 ATTGTTCATT CAAACCTTTC AACATCCAGT GAAACAAGTA TTATTTTTGT
484901 AATTTTACCT ATAAGAAAAT AGAAACCTAA AGGAGTTGAA CAATTTGCCC
484951 AAATTTAAGC AACTAGTAAG AAGCTAAGCT AAAATTTGAA ATGGAAGCGT
485001 GTTTTATTGA AAGGCCTATG CTGTTAGCTA CTCCACCATC CTACTAAATC
485051 TTATCATTTG TATTATTATG AAGTGTTTTT TGTAAGATCA TAAAATAGGT
485101 CATAGTTTTT CAGTTTATCA CTCCCTCAAA ATGAAGCTAC TTGGGTTTCA
485151 GATTCTATGA CAGAAGGAAT ATTTTGTTGT TTTTACATTG ATGAACAGTA
485201 TTCACATGTA AGAACTTCTT TGTTACAATT ATATCTAACT ACAAAGGGAG
485251 AAAGTGCTGA TGTATTTAAG TAAGAAATAC CCCACCTTAG GGAGAATGAG
485301 TAAACTAATT AATAAAAAGA ATACTTGTGG CCTGAGTATT TATATCAGTA
485351 ATAGTCATTT AAATTTCTGG TGGAGACTAT TGACTTTTTA AGCTAGAGAG
485401 AAAATTATTA GGAGTAGAGT ATTATGATCA CAAAACATAG ATCCACAATA
485451 AAATCCATAT AAAAATATCA AAAGATTTGT CCCTGTTATG TCTTTTTCAC
485501 TTTTTTTCCC CTGCCCGCTT GTCAAACCTT AGCCTAGGTA TAAAGCTAAG
485551 GATACAGTCC AAGGAAAGTT TGGTCCAAGA TTGTCGAATT ATTGTCTTTT
485601 TTAGGCTGTG TTTCTTTTCA CAGCCTGGAA AAGTTAATAG CTTTTGCACT
485651 TCTCTTACTT TATTTCACAG ATTTAAAAAA TTCACCTGAC TTTTAAAGTT
485701 TGACATTGTT GAGTATTGCA TTTTTAAGTG AGAAATGCAC TCTCAGATAA
485751 ACTCATAGAG CTACATCTAA ATAAGTCATT TGTGTTCATT TGGGACTTCT
485801 AGAGAAGGTC ATTTGGTGTA ATATTAACAA AAATTCTGAT TTAAATATTA
485851 ACAGTTTGAT TTGGTTTTAA CATTAGATTT CAACTCATTG TACTTTCAAG
485901 ACAATTTCTT CAGATGTTAT GTAGAATAAA AAGAAAGGTT TTGTACTCAC
485951 AAGTAACTCA GTACAATTCA CTCATTCAAC CGACATGTAT AGAATATTTA
486001 ATATGTGCCA TACTCATATG AGCCTCTGGG GATAAAAAAT AATAATAAGA
486051 GCTAATAGCC TATGCCTTCA AACAAGTTTC AGTCTGTATT TCTGTGAGGA
486101 AAATAAAAAG TTTAAATCAA AAATACAAGA TTAGTGACGT GTACTATCAT
486151 AAAGATATAC AAAGGATATG GTGGCAGCAT AGTGAAGATG ACTACTACTT

FIGURE 3MMMMMM

486201 CAGCACACAT GGGTGGTGAA AGGTTTCTGG AGGGTGAGAG GCTGGGGTTC
486251 TTTCTTGAAA GAAGAATAGT CATGGAACAG AAAAAGCATA AAGGCCTCTA
486301 ACAACATAAA AAATTTAAAG CGCAAATAAC TTGGTGTGGC TGTGGTGAGG
486351 AGATGAAAAT TGTAAAATGG TGGTAGATGA AGGTGGAGAG TTACACAGGG
486401 GCCAAACCAA GAGCACTTTT TAGCCATATT AAGGATATTT GCATGTATCC
486451 AGAAAATATT CAGGATCCAT TGGTGAATTC GAATCCTGGA TTAACATGAC
486501 TAGTAATACA TGCAAGACCC TATGCTGAGC AATTTACACA TATTACCTCA
486551 TTTAATTCTG ACAAGATTAT GCCTCATTTT AGAAACTTGT ATAACTTTAC
486601 CAGAATCTGA TACCTAGTGA TTGGGGGTGC AAGTTTAGAA CCCTAGAACT
486651 ATCTGACAAT GGCAGCAGAA GATGGTGAAA ACTATGTTCT GAATTACTGA
486701 TTCAGGAATG CCGCGAAAAT GACTTTGATT AAAACCTTGA AGAGATAAAA
486751 TGTCTGAGAA GAACCTGAAA ATAATATATT TGTGTAAACC TGATGTTTGA
486801 GAACATAGAA TGGCTCCTAA GTCAATTTAC AGTCTAAGGG AAATTCATTT
486851 AAAGGATCAT TAAAAAAAAA AAAAAAAACT GGTTAGCTTT AAATAGCATT
486901 TTCAAAGCCT GCTGTTTATA CCCAGGAGAG AATTTCAATG AATAATGCCA
486951 TAGTAGCATA TGGATAGGTT TCCCATAAAT TCAAGGATAT GATGATGTGA
487001 ATCCCAATTG ACGGCATCCA TCTTTTTCTC TCCGTACCCT CCTGGCTCTT
487051 CTTTAAATTT TATAGCCTTT GTTTCTCAAG TAGTGCCTGA ATTATTGTAA
487101 TGTCAGCCTT ATTATTAAGT TCTCTCTTGT GTATTCCACT TAATTGACTA
487151 ACTTTATAAT ACATTCATAG AGATGAGGTA TGGGTTGGAA AGGAGTGATC
487201 TCATTTGATG ATCTGGTTCA AATTTTTTAA AGTAAGCAAA ATTAAGTAGT
487251 TTATAATTCA GTTCTTTTTA GCCATACTAT TTTACTTTGT TCAACTTTGA
487301 CTTTGCTAAT GACCAAGGCA ATAACATAAT TATGAAATAA TTCCTTTTGA
487351 AAATCATAAT GTTCTTGACT GGCTACTTGT GCTATAAACA TAGTGGCATC
487401 TGAAGAAAAA TTATGGCGAC CCTCTTGCAC TTAGAGACCA GTGCTTGGTT
487451 CTTTTTCAAT ATCAAAATAT GCTAGTGGAG ATTCTCTAAC TGGCTGACAA
487501 ATGCTAAGAT TACTAATTAT CACTGTTAGC ATCATAAAAT GAATCTACTT
487551 GAACTGGAGC TATTGGTTTC CCCTCTACCG AAATCTATAA AACAACCTTA
487601 TTGCATATAT GTATGTGGAG GTAGAGATAT AGACAGATTG ATAGATGGAT
487651 CAAATTGACT GAAGATATTC ACTCATATAT AATCAGAAAA TTATTTCCTT
487701 GTATTTTAAT GTTCGCATTT TATGTATTTT CTGATTTCTC GCTGGGCTAA
487751 GTGTACAGTT AATATTATGT CCACTAACAG CATTTATTGA GTGCCTACTG
487801 TGTACTGGCC TTATTATTAG GTACTGTACT TGATTGCCCC CTTCCTTCTT
487851 TAGAATAGAT TTATCAAAAC TGCAATAAAA TTACAGAATC AGTAGTAAGA
487901 AAGTAAGAAT ATAAAAATAC TTCATATGGA TTTTCTTGGG AGATAGTTGG
487951 AAATTAGGTG TTAGAAGCTA GTAAAAATTT TCTCAAGATT AAAATAAAAT
488001 CTATATTATG CCCCAAAGCA TTAACCATAA CACATATCCA CACACACACA
488051 CTGGTCAAAT ACAGTCCTTT TTGGCTTATA CAGCTATAAT AGGAAATTTT
488101 AACTGCTCAA ATTTATTATT ATTTCTGAGC TTATTTTCTG GGCCTTTCAC
488151 TGCAGAAAAA AATGAGAATC AAAATAAAAA ATTGTTGACA TCACCAGTAA
488201 TATTAGCCAT AACTTATAAA TTGCTTGGAA AAAACATATT TGATACATTT
488251 TAACAATAAT CCTGTTAAAT TACACTTACA CATTTTAAAA AGTAATAAAA
488301 TAAAGATAAG GAAATAAAAT TTTTGTTTTT ATTTAAAGCA CTAGCAAGAT
488351 TTATATAACA TTAAATTCCA TATATATAGT AGCAGTAAGT AATTTTGCAT
488401 GTGCAGTTTT AAAACCAAAA TAAAATGTAT TCTGCTAGAT TGTAGCCAGC
488451 TTGAACCTTC TGCTTAAATA CTGAAAAAAT AGCTTGTGAG CTATCAAAAG
488501 GGAACAGAAT CCATAGCTTA AAGCCAATTT TTGAAAGAAA ATTGGAATTT
488551 TACATGTAGT AATTGGCAAT TTACCTCTTC CATTGCCTTA ATAATTATCT
488601 AAATGACCCA CAAGAATTAA TACATTGCCA ACATATAAGC AATGCATTCC
488651 TCTTTTCTGA AAAGATTAAT TACAGCTTAC ATTTTAACAA CACGTAAATT
488701 TAAGTTTTCA CCTGTAGGCT GCATAAATCA GTTTTGTAGC ACAAAAGCCA
488751 CATCTGTCAG CATTTTAAAA TGTATTATTT ACCAAAAGTA GTAATGATGG
488801 ACTAAATTTA TAGCACATAA AATAATCATA TAAAAATCAT TATAATCAAC
488851 ATTAACAAAC CAAACTGTAA ATAACTACAT TATAGTGGGT ATTTCAAAAT
488901 AAAATCTTAT GTCGTGCCTT ATATATTTTT ACAAAAAGTG GTATGTAGAT
488951 ACAAATGAAT AAATGTAACC ACTTAATTAT TTTGAAAATA TCCATAAGAT
489001 TTAGCTGTTT TTGTATGGTT GATATGTAAG AAATTTGGTT TGTTTTAACC
489051 ATTTATAGGT AGGAAATTAT CCTAAAAAAT AAGATGCAAG ATTATGTTTC
489101 GGTTTCTTCC TCCCAATACA TTTTTATGTC CCCATTTGAT GAATTTTTCT
489151 AAATTCCATT TGCACACTTA AAAGTTCTAA ATCATTGCAT ATGTTGTATT
489201 GAATAGAATG TGAATTTCTC AGCAAGATAT TAGGTCCCCT CTAAATGTAA
489251 TCCAAATTGA TATCATTTCT ATCGATTTCT GCAAATTAAG GTATTCTCTG
489301 GAAAAATTAG ATTATTTGGA TGCTTCATGA ACAAAATAAT CTGTATCTTC
489351 ATCATATCTA AGATTCTTCT ATGACTTCCA ACTGGAATAT TCAGAAAATG
489401 ATCACATTAC AAATGATCAC TCTAGCTTCC ATGCCACTTT CCTGAAATGT
489451 TCTTGCCAGT GAGAAATCAT CACTTCTTCC TTGGAATTTC TAAATATTTT
489501 ATTGTTCAAA GGCGTAATTC TTTACTAAGT TGTAAACTCA TTGAGATAAA
489551 GAACTATAGT CTGTATATCT GTTTGTCTCA GAAAGTGTTT TACACATAGT

FIGURE 3NNNNNN

489601 TAGGTTCCAA TATACATGTA ATCAAATAAA TAAAGAAAAT ATGATTTACA
489651 AAAATACTAA AGAATGGTAT GTTGCCTACC AGGTCAAAAA GAAAAAGAAA
489701 TACTAAAATA CTAAATATTA ATATTAAAAT ACTAAAGAAT AGTATGTTGC
489751 CTACCAGTTC AAAAAGAAAG AATCAGATAA TTTTATTTGC CATAGATAAG
489801 CAATATTGCT TGCTTTATTT TGGGTAACAA GCTATAACTG GCTTGAGTCA
489851 TGTAAAAACA TAATATATGC AAGTTTTACT ACAAATTAAT TGTTAATTCT
489901 AAATTTGGGG GCACATTTTA GGTAGGGTAA AATGACGATT TTGTTGTTAA
489951 CACATTTTCT TCCCTAAACT CTTTTTTAAA AACCTCCATT ATGTTTGATC
490001 CAGTCTGTTG GTTGAAGCAC AATCTGTACT GCTTCAATTA CTTAGGATGA
490051 AATTAGCCAC ATCATTATTA ACACCAGCTA GAAATTTTGG AATGATTATT
490101 AATGGTAGCA CATGAAGCAG AAAGAGGACC AGCTGACCCT GGTGGAGTAA
490151 TAAAGTTAAT TAATCAAGCA GGAGGCAGAT TTCATATTTA TGAGTCTACC
490201 CAGAGGAGGA CAAATTCCAG TATATAAGAC TTTAATTTAA AGTAATCTCC
490251 AGTCAATAGC ACACTTTCAA CATTGGCAGC CATAGCCATC TAAATGCAAA
490301 CATCAGTGGG AAAGAGGAAT TTTCTAGCAG TTAGGTTGTC TGAATATAAA
490351 GTGGCCTGTC CTATAAGGTA GCGAAGGCCC CTCATAATAA GAATTTGTGC
490401 TGAAGCTAAT TGGGAACCTG TTTAGCATGT GGTAAAAGAA ATCCCTGCTT
490451 TATTTAGGAG GTTGTGATAC AAGTTTAACG TAAGTTCAAA CATTGAGATT
490501 TCATAACAAC ATATTTGTGA GTTCTAATTA TGTTCCAATC ACTTTTTTAA
490551 AATCTTTTCT GGTTACCAAA ACATGTATAG CCTTTGCAGA AGATACTATT
490601 ATGCCAATTT TACAGATCAA GAAAGTAAAG CATAATGAAG TATAGTAACT
490651 TAACAGTACC CACAGGTAGT AAGCATTGGA ATGGGGTTAT TATGGCATTA
490701 GGCCCTTTTC ATACTAATGC TTAGAACCAA AATTGAGTTC CCTTTCTACC
490751 CATTCAGTAC TTTCACTTTT CTTTTTCACC TTAGTCATTA TTTATAATTT
490801 TCTACATGAC TATTTTTTAT TATTACCTCC AATTCGTCAC CCTCCCTTAA
490851 TTACTTATAT TTTGCCTTAG CATAATGTCT TTGAATATAA GCGGATTTTC
490901 AGAAGACTAT TTATAAATCT CAGTGCATCA AGTTCACAGA GCTGTGCAGT
490951 GTTTTAATGC ATATTTCTGG ATTAATGTAC ACATGGTAGA CCAAGTATAA
491001 CACTCCAAAG AGGCAAAATA ATGCAGTTAG TGTGATTTAC TTAAATATGC
491051 AGGGTCTTGA TGAAGAGTAA CTATTTGCAC AGAAAGTAGA AGTCGCCCTT
491101 CAAGAGAGAC TGAATTGACA AAAAAAAAAA AGATATTTTA TTTCAATTAT
491151 GCCTAGATCA AATAAGGATT TTAAATGATG GGAACCAGGC TTATGTACCA
491201 TAAGACAGAT TGAAGACCTT AATATGAAAA ATATTAAAGA TCATAACTTT
491251 GCTAAATGGG CTGGAAAGAA AATCATTAAC TATTAACAGG TACTTAGATG
491301 TTGTAAAATG TGCGTATCAA AGGGCAGTGT TACAGCGTGG CTCATATTTA
491351 AAAGAAAAGT AACAACAGTA GATCTATTTC TTAATACAGA AAGTAAGCTT
491401 ATTTTTAAGG CAATAACATA TAGCAACATA TGTAAAATAT TATTTCTTTG
491451 GTATATAAAC CATCATCCCT TGACTGGAAG TTTTTACAAG ATCAGGGAAC
491501 ATTTCTTTTG TTTCTTTTTT TAAAAGATTC TCATTTGTGT ATGCTGTGTG
491551 AATTTGTTCT CTTAGCAAAT TTGAGGTAGG CACTACAGTG TTATTAACTA
491601 TAGTCACCAT GCTGTATATC AGATTCTTAG AACTTATTCA TCTTATAACT
491651 GAAGACTTGT AGTCTTTGAC TAATATTTCC CCATTTCTTT CTCATTTTTA
491701 TACCTCTTAT ATTGCTTTGC ATGCACCTGG CAAGTAGAAG GCACTCAATG
491751 AATTTCATAT GAATTAATAT TATCCAATAA ATACACAATA CTCAGTATTT
491801 ATAAATACTC AATATTGCTT CAAACACATG TATTTTATTA GTCTACTTAT
491851 ATATTTTTAG TATTTTATTT TTGTTTATTT TGTACATATA TTAATAACAA
491901 GCAATCTGCT GAATGCTAAG GAAACAAAGG AGATAATATA TGGTCTCTGT
491951 CCTCAGGAAG CTTATCACTA ACCCACACTA GAGATAAGAG AGTTCCTGAT
492001 TTATGTCATT CCCAAAGTCT GATTTTAATT TGACTTGATT TGAGATGGAT
492051 TTTTTTTTCT ATCAGCCATC ATATAAATTG CTTGAATTTT TCTTTCAAGC
492101 TATTTGACTT TACAACCTTG AATTCTTAAA GAGAGCAAAA ATGTTCCTTA
492151 GGTATTTCAA ATTGCCCCAA ATTTAGTGAA AAATATATTC TCTATGTAAC
492201 ACTTGAAGAG TTAGAGCCAT TCTTCAGACT ACACAAATCA GCTTTATTGA
492251 CTTGTATTTT GATATGGCTT TTCAAAAGTC GTATTTTAGT TGTTAGAAAA
492301 ACATCAAGGG CAAAGTGAAG AAAACCTAAT TTCTCATTAT ATTAATAACA
492351 GTATGGAGGC CTATTGAGAA CTGTTGGAAT GATTCTTAAT TGTGGCTGAC
492401 CTCTCACCCT CATCTGTTGC ATGGTCATGC ACTAAGCTCA AGTAGGGAAT
492451 ACAAGTATTG TGTTGTTCAG CAAGTACCGA TAGAATGATG TTTTAAAGCA
492501 TTAGGAGAGC TCTAGCTGGT TGTAGAGTAT CATAGCGATG ATATATAAAT
492551 GTGGTTCTTA CGGGGAAAGG GTAGAAACAC ATGATGCTGA GACGAAGTTG
492601 GCCTTTGGGA AGTCACAGAC TGGAAGGATG ACATAGCATG GGGTTTTGGT
492651 TTCTGTTTTA ATTTTATGTC CTGGTCAAAT TCTATCCACA TGGTAATCCG
492701 TTATTTTTCA GAGCTGAAAA AAAATCTGAG AATTGAATGA AAGAGTTGTA
492751 AAAATGTCCA AGTCAGGTTA AAAGTATTTC ATATAAAATA TATGAATATT
492801 AAATATTATA TGTTTATGTC AAAATATAAA AACATCGTTT GAAAGAATTT
492851 AATTTGCATG GTGCCACTCT TCAATAAAAA TCATTTAAAA TTATCTAATG
492901 TAACATCTTC TCAATTTGTA TTAGCCCAAT GCAAAACAGC TGTTTGTGCT
492951 TTTTTCACCA TAAAGTCACA ATACTGAATG GACAAATGTT TATAAAATAA

FIGURE 3OOOOO

493001 ACCCAGCCAG TTCCACAAAG TCCTGTATGA AGAATTAAGA AGCAGCTTAA
493051 TGGCCGGGCG CGGTGGCTCA TGCCTGTAAT CCCAGCACTT TGGAAGGCCG
493101 AGGGGGGCGG ATCACGAGGT CAGGAGATCG AGACCATCCT GGCTAACATG
493151 GTGAAACCCC CCTCTCTACT AAAAATACAA AAAAATTAGC CAGGCGTGGT
493201 AGCGGGCGCC AGTAGTCCCA GCTACTAGGG AGGCTGAGGC AGGAGAATGG
493251 CGTGAACCCG GGAGGCGGAG CTTGCAGTGA GCCGAGATCG CGCCACTGCA
493301 CTCCAGCCTG GGCGACAGTG CGAGACTCCG TCTCAAAAAA AAAAAAAAAA
493351 AAAAAAAAAA AGCAGCTTAA GTATTCATGT TACACTTTAC TTTTTCAAGG
493401 GAAACAGTAG TTCCCTTGAA ATTTAAATTG AGTAACAAGA ATTCTTGGCA
493451 AAATTGCAGG AGCGCTTAAA AGATTTAGCT GTGTGTGCAG AAACCCAAGC
493501 ATGACATGTG TGAGCACATT ACTGTACTAT AAAGATAGGC AAAGGAGCAG
493551 AATACGGCAA TCTTACTGCT AGATATAAAA TAGCTGATTC ACATCAAACT
493601 GAATTTCATA TTCTCTTATG CTTCTGGAAA ACAGCATTCA TTTAAAAATT
493651 CTCTTGCACT ATAGTTTTTT TAAATTAGTT ATCTTATATT TGCTGGATGC
493701 ATAATCAGTG AGCAGACTAA ATAACTTTGT CAACAAATAA TTTTGGCAAT
493751 TCCATCAACA ATAAACATGG CAATATTACT TACTGAATTT ATCACACGTA
493801 AGTGTGTGTA TATATATGTA CATATATACA CACATTCATA TATATAATAC
493851 ATATATTCCA CATTCATATA CACTTCCTAT TCCCATTTTG AGATAAAGGA
493901 ATGAAATTAT CATTATTTTA AATATTGTTA CATAAGTTGT TACCCTTGGA
493951 AGTAAAAATG ATTTGTTTTA AAATTTGATA TAGTTTGTGT TAAATTTAAC
494001 ATGAAGGAGA AAGAGAAGGG CGCTTGAGAG GAAGCAGTAA AAGCTAAAGC
494051 AAGCAGAAGA ATGTTTAATT GTTCAACTTG TTCATTCACC CATTTACTCA
494101 ATCAAAACAT ATTAATAAAT GGGCCAGATA TAGATGTAGG CACTAGGAAT
494151 TCAAAAACAA AAAAGGATAA ACCAGTTCCC TGCTTTCACA ACAGCTAGTG
494201 AGAAGTTCAG AATATTAAAC AAGATTTCCA GTAGAAGGCA ATATGTATTG
494251 TATAAGGGAG CACAAGGAGG AAAAATGCAA ACAAATGTGT CAAGGGANNN
494301 NNNNNNNNGG TTGAGGGACC AGATGAGGGA ATTGGGGAGC TTTTGCTCTT
494351 TTTAGACAGA ACAGTATCTG TGCAAGTGTA GAGATCAAAG AGAAGCATGG
494401 AGCTTTCTAG TAACTGGAAG AATGTCAGTA TAGCTAGAAC TGTGCTTTTC
494451 CAAAAGTGAG CCCTGTGCCA AAGGCATCAG CAACACCTGG GAACCCACCA
494501 GAAATGCACA TTTTTCAGAC CTCCCACTAG ACCCACTAAA TCAGAAACTC
494551 TGGGGGTGGG ACCCAGCATT CTGTGTTGAC AAGCCCTCTG GGTTATTCGG
494601 CTGCAAGCTT TGGTTAGAGA ACCAATGTCA TCCTCAAATA GCACAACACT
494651 GGCAGCAAGG AATGGTGGGG ATGATGATCT CAGTACAAGA AACACAAGAT
494701 ATGTGGCTAG TGAGGACCAT GCAATGCCAT CCTTACCTTG CTACTGAGGC
494751 TCAAATTTCC TAGGTTTTTA TTTTTCTTCC AGCTGTATGT AGTTTTGGAG
494801 ACAGGCAATC CAGTCACAGC AGTGAGCTTC CCGTAACTGA CTTCCCTGAA
494851 ACCACTGCGA ACACATCTAA TTATTTCCTC ACCTTCATTT TACCACACTA
494901 AAAATAAAAC CTTCCAAATA TCTTTTTTCA TTGACACTCC TATAGCTCTC
494951 ATAACTTCCA AATTCCCTAG AGACGATTTT AGCCTTAAAA AATTCACCTA
495001 CTGAAGGTGC TAGAACCTTG GGAATCATCA ATTTAAATTC TAATACATGC
495051 TTGCTCTCTG CCAGCATTTA AGCCTGCATA TGTCTCTCTG ACAGTTCATA
495101 TTTGGTCTGT GAACTTTCTG AAGATGCAGT AAATTATGAC CTGCTCACCA
495151 GAACCTTCTG AGAAAACTGG AGCTAAGCCA TCCCAAGTCA AACCTTCCAA
495201 GAAAATCTAG ACATTAAGTT ATCTGGGAAA CTTAGTGAAT TTAGATAGCT
495251 TAGGGGTAAT GGTGATATGT TAGCAAAGGA AAGTTGGACA CCAAAACTGA
495301 CATGCCATGC AAAGGCATTT GTCTCAGGCT CAGTAACATA GAGGTACATT
495351 CTAATTGGTG AAAGAAGAAA TGCTACATTC AATTAGGCAT CATAGGACTT
495401 GGTTTCTTGG CTCATGAGGA TTCTCCTCTT TAGAACCATA AATGAAATAA
495451 AGCAAACATG CTATATTATC TTCCTTTGCT CTAAAAATGT GAAACTCTCC
495501 AGGTATTGGG ACCTAAGGAT GGCAATGTAG TTGATTTATG TTTTGGTTTC
495551 CTCATGGGAA AACTAGAAAT TTATTCATTT GTATGTAGAG TCATTCATTC
495601 AAAAATATTC TTGAGATCCC ATTCTGTACA TACTCAGGCT ATAGCAGAAA
495651 TAGACAAAAA TCCCTGCTGT CCTGGAGCTT ATATTCTAGA GAGATGAGAA
495701 AGACAATAAA CAAACAATAA GCAAAACATT TTATATGCAG AGATGTGGTG
495751 TGTTGCCTAG ATTTCCCCTT CAGGACCCAA CTAGTGGGAG TTCTGCCTGC
495801 TGAAAGCTCA TAGTTGAAGG CTCATAGCTG CAGACATTGC CCCTGGCCAA
495851 AAGAAGCTAC ATGCCCCTCT TCCTGGGGAC AGTCAGAATC CAAGATTCCT
495901 CAATGTGATG TACAAAGACC CATGCCCATT GTGTCAATTA AAGACAACCC
495951 AGAAGAAGAC CATCCCAGCT CCAGCACTCC TTGGGGTCCG CTGAGGTCTT
496001 TGCAGCTACC ACATGTCAAG TCAACAGCTG CATCTTTCCA TGGGCTTCCT
496051 GTACTCCCAC ATGTTCATGC TGAGGTCACT CCCCAGAAAA CATGCTGCAA
496101 GCCAAGCTCC ATTGCAGAAT CTGTGTCCCA GTAAACCCCA TCTAAGACAG
496151 ATAATAAGAG ATATTCTGGT GCAGAGTAAA GCTGAGAAGG AGGATAGGGA
496201 GTATCTGCCT CCTAATGTGA GAAAAGTACT CACTGCAGTA TCTGACACAA
496251 GTAACACGTG ATCATTCGAA GTTAACTATC ACCATAATCC TAACGGTTAC
496301 TCCAAACTAG GCAACTGGCA AAAACTTCAG GGAGGATGGC CTGACTTTGG
496351 TCTTGAAGAA AAGGAAGAAC TTATACAAGC AGAAAGAAGA AAGAAATTTT

FIGURE 3PPPPPP

496401 TTATGTTAGC AACTGATTCA TGCAATTCAA TTTGGCAGGT ATTTTGCAGG
496451 TAAATTGCAA AAGAGAATTA GCAAAGAGGA ATTTTGTGTA AAAATTCAAG
496501 CTTTGTACTT ACTTAAACTT GGATTTAAAT TTTGACTTGA TCACATCTCA
496551 AATATGGGAC TTTGAATAAG TCAGTTAACC ACTCTGTGCC TCAGTTTCCA
496601 CATCTGGAAA ATGGATATAA GGATACCACC TACTTTCTAA GGTTCCTGTG
496651 AGTATACAGT GATTCAATGC ATGTAAAGTA CTTAACAACA GAAGAGTATC
496701 CAGCTATCAT GTGGTTAGAG CTCAATAAAT GATTATTAAT ACTGATATTA
496751 TTGTTACTAG CTTTGAATCT TAAATTCCAT TCTAACAGCT TCAAAATAGT
496801 GTTTAAAAAT GTTCTTTACC TTCTTGCATA TAGATACCAT ATAAAAGCAA
496851 TCAAATCATT TTCTTATTCT TCTCCTGATA TTTTATTTTT TATACCCATG
496901 AATTTACTAT AAGGATAGTT AGCTAGTTTT GGTGTTAGTT TTTGTTTAAT
496951 TTATATAGGT GACATAAAAG GAGGAGTGGA ATTCCCCAAG GTATGTTGAC
497001 CTCCCAGGGC TTAAGCACTG GACAATTTGA CTCAGCTGAA GAAACTCCAC
497051 GTTTTGACTT CTGAGATACC AAATCTTAGT GAGCACAGCA GGCAAGTCAG
497101 GGGGCCTCCA TTAGGCCCAT TCCAGCAATA TCACCTTGTA GATCCAGAAC
497151 TACTCTCTCT ACTGTTTCTA TGGTAATCAA ATTACTTAGA AGTTGGCCTA
497201 CTTTTCTTTT AAACACTTAA CACATCAAAT GTCTCAGTGC AAACAGACAA
497251 CATAGGACAG TGGTTAGAAG CTCGAACTCA GGAATTGGAC TATCTGTAAG
497301 TAAATTCTGG TTCTGTCCTT TCTAACTATG TGACCATGTG CAAGTTAATT
497351 AGCCTTTTTG TGCCTCAGTT TCTCCATCTA TTAAATGTAG GTAATAATAC
497401 TACCATTTCT TATGATTATT TTGAAGACTA AATGAGTTAA CATATGTGTT
497451 TAAAACTATG GAGAACACAT AAAACATGTT TTTTAATATG ATAATTACTA
497501 CCCTTCTTCT GAGGGAAACT CCACTGAGTT CAGTATGATT TTTTGGACCA
497551 TCCTGTGCCG TGAATCAGCT GCTACTCCCC TACGTAAAGA AAAAAGGAAA
497601 TAATTAAAAA GAAGAAGAAT GTAATTCTGG CAAAAGACCT TTTGTAGGAC
497651 AGCCTCTGTG GAATCCTCCT CTGTTTTCAA ATGGAAATGA GAAGACTTAT
497701 GTATCATAGC CACCTACTCC ACTACAAATT TTTTAAAATT AAAATAATAG
497751 TCATCTCATG AATGTCCTTG CACAGAAATA AGCAACTTAC CCGAAAACAA
497801 GCTTAGCTAT ATATTGAAAA TGATATTTTT GGCTCAGAAT AGGTATTAGG
497851 TATGTTATCA CTTCTTGAAT ATAAACACAG AATATCTTGC TTGAAGAAGG
497901 ATTTTACTTT TCAAATTATT GGATAGACAC AGTTTTGAAA ATATTTGAAC
497951 TTGAATAAAA TCACATTTTG TTTACTGAGC ATAATAACTG AAAAGAAGGC
498001 TACTCCATTC TTTTCTAACT TATTCCAAGT TATCTGACAG ACAAACAGAG
498051 CACCAAGTAG GAACACACCA AAAAGACTTG GGGCTTTCTA ATTACCTTTG
498101 GCACGTGCCT CTTTTTTCTG TCACGTTCTG TGCTGCAGCT CAGAATGCCT
498151 TTGAATCCTT GTGAATCTTT GACAACTACT TATTGTTTAA CAGAATAGTC
498201 CCAAACATAT ATATAACTAA TTTAAGTTAT TAATGTCACT CAATAGAGAT
498251 GAGAGAAATA CAAGAATAGT CCAAATTTCA TGTTTTAAAC AAAAAAAGAT
498301 GAATTTTTAA AAATTATTAT TATACTTTAA GTTCTAGGGT ACATGTGCAC
498351 AACTTGCAGG TTCGTTACAT ATGTATACGT GTGCCATGTT GGTGTGCTGC
498401 ACCCATTAAC TCGTCATTTA CATTAGGTAT ATCTCCTAAT GCTTTTTTAA
498451 GCAGTAAGTA GCACGACTTT CCCCATGTAT ATAATAACAT ATCTAAATTG
498501 GTTTTAATTT TTATAGGGAT GCTTTCTCAG AGGACTAAAC AGAGGAATAG
498551 TGATTTTTTA TCTGCATTTC TCTTCTTCCT AAGAGCATTT GAGGCAGTTT
498601 AAAATGTATG CACAAAATGT TTAATAGGTT AGAACTAAAA TAGAAAATTA
498651 GGTCCATATA CACAAGAGGG AACATAATCA TTACTAGAGA TGCACATGTA
498701 TGTGCCATCT CTGCCTCTGA AATTTCCAGT AGCAGCCAGA GAATAGAAAA
498751 GTTATCATAC GCTCATGAAG CACAAATGTT CTAAGAAAGA TTTATAGAAG
498801 CCATTGAGGA AAATGGCCTC AAGCAGCTTT TTCAACAAAT ACAAAAGTTT
498851 TTTGTTTGTT TGTAAATGAC ATTTTCTGAC TACAACCTTT GATAGAGCCA
498901 AGGTAAAGTT TCAATGATTG AAGATGATTT TTCCATGATG GGAGAAAGGA
498951 AGGTTACTTA ATTCATTCCA TGCACACAGA CTTTAAGACA AACTATACCT
499001 AGGAAGTAAA TGAAAGGAGT TACCTTTTAA ATTTATTTTC TAAAAATTTT
499051 GTCTGTTAGC CAGGAACTTA AAATCAGAAT AATCTAATAG GACCCTTTGA
499101 TTGCAGATAT CACATAAACC ATGAGCTAGG TTAAGCAAAG AGGAATGAAG
499151 AAATGTCCCA GACTAGGCTT CAAAAAAGAT TGAGACAAGA AACTGGAAAA
499201 TTCTCCAAAG GAAAGACAGC TTTTATTCCT GATCCACACA GCCACCAATC
499251 TCTGTTTTGT GCTCTAAAGA CTAGTTTTAC CTGTGTTCAT TTAGGAAAAT
499301 ATGTCTATGG CTTATAAATC ACATTTCCCT TAGTGTCAAC CATGCATGAA
499351 AATTGCCAAA CTGATTGTGA ATCCTAATCC CAAATTCCTG CAAGAGGGAA
499401 TGTGGTTGGT CCAGTTTGGG TCAGGTCTCT GTCGGTAATC CAATGCATAT
499451 GACTGGGTGC CAGAGACAGG GAGAACAGTC TTCCAAACTC CTGCCCTGTG
499501 GGTGGAGGGA GTTTTCAGAG ACAGGGCTGA ACAGATACCT CAGAGGATGT
499551 TTACTAAGAA TTTTGAGGTT GGTCTTTAAT GAGTGCTTAG AATGTAAATT
499601 TTCTACTTTC ATATCAATAG ATGATATAAA TGGTACAAAA ATATGGTGAA
499651 GCAATAGAGA AATCCTTCCA CTATAAATGT TGAGAAGCCC AACCAGTATT
499701 TTTGCAAAAG TAAAAATAAA ACCTCTCCAT GTTTATGCTA AAATGGGCTG
499751 CAGGCAAAGC AAAGATTGTC CTTAGGAAGC AGATTTGAAT CTGCCCCCAC

FIGURE 3QQQQQQ

499801 CGTTAGATAC ACTCTAGATT GAGAGTTCAG AGTCCCCCAC CACAGGATAC
499851 TGGGAAAAAA GATGATTCTG GCCTGGAAAT TTTTCAAAGC AGGTGTTGTT
499901 GCAAGTCATC AAAAAGAAAC CCGAGGAGTA ATGCTCCCAT GGAAAAAGTT
499951 ATATTGAACT GCGTAGCTCT GCACTGTGCT TTCCTGGATA AGCTATAGAA
500001 AAAATATGCA TGTACAAAAT GGAAATATCT TGTCTCATTG TGTGAAGTTT
500051 TGATCAATTG CCTTTTGTCT GCCAAAGAAA ATGATTTTCA ATTTGATAAA
500101 GTTGGTGATG CTCAATTCTT TCTGGCAGCA GTAGGATAGC AGAATTATTT
500151 GTATCCTGAA GTTAATTCTA GTTGTTGAAA ATTACACCCA TATCATCAGC
500201 ATGTAGGAAG ATGCTTATCT TTCTACCTGC CATGATGGCA AATACCCAGT
500251 TTGTCTAAAA TCAGTGCCAT ATTGTGAAGA TACTAGTTAA AAATTAATAA
500301 ATAAAACACA ATACTGGTTT TTATATTACA TGACAAGGTG AATGGGTATG
500351 TCAGGAAATG TTCCCTTTCA TTTCAGTTTT AGAAAGATAT TTACTCCCAC
500401 ATTTGTAGAT CCTAATATTA AGCTTCATTT TTTACTTAAC TCAATTCCCT
500451 AGGCAATGAA GTCAAAATTT TGTGAAAAAA TCAATATGCA TAAGTAAACA
500501 ATCTTATTTT CTTCAAAATA ATAGTAGTAA ATAGTAGGGC AATACTGTGC
500551 CAAAAACCTT CTTGCTGCTA ATACGAATTA TTTAACTTGG AGACCTCACA
500601 CACATGGCTT AAGGAGAAGC AGGGTGTAAA TAATTGAAGA GATGCTGAAA
500651 AAATTGATGG AGCCATAGTT TTGTGCTACC ATGGGGTTGG CCTTTTTAAA
500701 ATAGAATAGT CTCCCATTGA ATCTCTCCAG AATTAATCCT GATGATTGAT
500751 TAGAGGTAGT TTGAGGTAAA TAGTTTGGTG TTCTTCAGAA CAGGCTTCAA
500801 ACAATGATCC AAAAGCTTCC CTTAGAACTT ACTCACTTTC AGGAGATGGT
500851 TAAATGAGTT TTGGCATAAA GCAATAGCAG GTCCTAAAAG AAATATACTT
500901 GGGTCCATAA CGCTAAGAAA AATTGGCACC TGGCATTGTG GTTAGCCGTG
500951 CTTCCATAAA TAGTTCTACT GATGCCAAAT AAAGGACAAC TGTAGCCTCA
501001 AATTCATGTT ACCATAAACT GTGAAAATTC ACTAAAAGCC TTCCACAGGA
501051 ATTTAGCTCC AGTATTTTGG TGATAATTAG TTTATAATTA GATAGGTTTC
501101 AATTAAGCAA AATATTTCAC ATTCTAACAT GCTGTCTTGC TAAACTTGCC
501151 AGAAATGTTG TCTGCCCATT TGTTTTTTTT TCTTTTTTTG TTTTTGCATC
501201 TATGCAATTT TTATTAAATT GATACATGAG ACCCATTAGA TATAGGACAG
501251 ACAGGACTGA TTTCCCCCCA AAACTATCCA TCTATTAAAG AAAAATAAAT
501301 TGGAATATCT CCTGGCACAT GTGTTAGTCT TTCTGTAGAA AAAGGTTGTT
501351 TTAGAAAGGT AAGCACATTT CCACTCCATT TCACCCTACA CTTCCAATCC
501401 TATCCATCCA GTTACCGGGC AAACAGACTT GGGAGGCTGT GTTTATCATC
501451 AAAATCAAAA GATGACAGTA AGGTTAGATA GAAAACATTC CCCTCAAGCA
501501 ACATAATAAA CAATGAGAAG TAACTATACC TAGTTTGGAT ATATAAAGTC
501551 CTGCATCGCC CTGCCCCATA TCAGCATTTA CATCCAGTCT AATTATTTTC
501601 TCTTGGTTCA TTATATTCCA TAGGACTCTC CATTTCAAGT GACAAAACTG
501651 TACTGGCTTA ATGAAAAGTG GGACTTTATT GCCTCAGGTA ACTGAAAAGT
501701 CAAAGGGGTA GTGTGAGGGT CGGGCCAAAT CCAGGCTCTC CAATGATGTC
501751 TTCAGTGATG TCTCAGTCTC AGTTCTGTTT TCTTCTCTGA TGGGTTTGTC
501801 TTCAGTATTC TCATGTATTT GCAAGAGTTT ATGTCTCTGG TAAAAATGGC
501851 AATTTTCATT AAACTAACAT CTACATATAC CCTATTCTAG AATCTGAATA
501901 TTAATAGTAA CTTGAGAAAA ACTCAAGCAT GCTGACTGGA GTCAGTTTCA
501951 GTTTAAATTA TTATGACCTC TTCCTTGCCT ATCTCTCCAA CTTCCTCTTG
502001 TGCATATTGG TATGTGTCCC AGGCATCTCA AAGTACATAT AAACTCCTGA
502051 AGATGTTGTG CTATTTATAC CTTCGTAGTA TTTGTGATGT TTCCTCAAGC
502101 CACAGTGTCC AATATCTACT TACCATGTTG GTGACTTGCA GATTTCTTCG
502151 AATCATTCCA GATTTAGTTT AAGAATTACC TTCTTTATAA TCTTCCTACG
502201 ATTTTTTCGG TGGAGAATAC CACCCTCCCC CTCTTGTCCT GTGACCTTCA
502251 CACATACCTC CATTCTAGCA CCAATGTTTC TGTATTACAA CTATGATCTG
502301 CATCTCTATC TCTCTCACTA AAGAGAAACG CTATGAGGAA ATCACACTTC
502351 AGTTTTCTTC ATCTCCCCAA GCTCTATATC ACAGTGCTTA GCAAATGGTA
502401 TTTTTGTTGT TATTGAGTGA ATAATGAGTT GGTGAATGAG AATTTCCTCA
502451 AGAAATTATT TAGATTTTTT TTCTAAATAA TTCTGTTTTT AAAATCATTT
502501 TCTTTAAATA TTTTTTCTAT GAAAAATAGA CTCCAAATAA ATCTAAGTTT
502551 ATACAGTTCA TACAACTTAT GAAATTTGTG ATCCCTAATG ATTATCCATT
502601 TCATTACAAA GCTCTTTATC TCAAACCACA GTAACTTATA TTAAGAAGCT
502651 ATAACCCCAA GTGCATAGAT ATGCTCACCA ATGTGCAAAT ATCTACTATT
502701 AATATTATGG CACATGGTGA ATAGTATTTA AAATTGAACA TCATTGGTTC
502751 CAGGTCAGTG ATCCAGGGAT GTTGTGAAAT TTGTATGGAA ATCCTATTTT
502801 ACACTGGATC TTAAAAGACT TTTTAAAGGA TGAAAGATAT ATGCATGAAG
502851 ATGTAAATAT TCTTTGAGAA AAATGTTCTC AAGACCTATC TCAACTGCCA
502901 GTAACAATAT GAAATACAGA CAATTACAAA TTACATCTTT GACATTTAGG
502951 ATGTTGACCG TAGTTTCAGG TGTTTAAATG TCTCAATCAT TTTCTTTGTT
503001 CTTTGAAATT TGTTATATGA AGGCTACCTA TGGTAAGGCA TCTTGACCAT
503051 TCATTAATGA ACACAAGAAT CTCTTAAAAT AAAAAAAAGT CAGAAAATAC
503101 TTCATTATGC TGCGCTATTT GCCTCTGCTT CTGCTTCTCC ATTAAATTGT
503151 ACCAAAATCA CATTTTCCAA TTATTCCTGT GTCATTTGGC ATTTTTACCT

FIGURE 3RRRRRR

503201 GACAAGTAAA TTGAGGTCAT CAGGAAGAGT GAATCTCAAA ATCTCTGTTG
503251 TTTCAGTGTA GCCACAGTTT GATATACTGA ATTGTATTGT TTCTGGAGAA
503301 GTGGCAGAGG AGTAGAAGAA GGCACAGCTA TGAAATCACT TTCTGAAAAA
503351 AAAAAAAAAA GTATGATCCC TGCTAAGGGT CTCTGCTTCA ACAGAAATGA
503401 TCCATGAGGT TTGTTTCCAT TCAGCTGAGA AATCAGTAAT CAGCTTACTT
503451 GAATGGAAAA AAGAAACTCT TGCTATTCTC TTTTATTTCT AATCTTAGAG
503501 ATACTTTTCC TTTGGGTAGA TAGCATCAAA TATTGAATGA ATGTAAAAGA
503551 AAAATATCAG TATAATACTA TGTTGACTAT ATTTACTTTT TTTCAAAGCC
503601 TAGGCAGGGA TATTTAGGAA AAAAAATGAC CCACATTATT TTCTATTAAT
503651 TTATTTCTGA ATAAATTATT ATTTCTAATC TTATATATAT TTTCCTTTGA
503701 GTAGATAGCA TCAAATATTG AATGAATGTA AAAGAAAGAT ATCAGTATAA
503751 TACTAAGTTG ACTATTTTTA CTTTTTTTCA AAGCCTAGGC AGGGATATTT
503801 AGGAAAAATA AATTTACCCA CATTATTTTC TATTAATTTA CCTCTGTACA
503851 TACTGATTTA CAAAATACAA ATATGTAAGG GAATGTAATG TAAAATTACA
503901 ACGTGTTTAA GCATTACTGT TGACACACAA ATCAAGTAAG AAAACTGTTC
503951 TTTAGCCAAG GGCATTTTAT CCTTATATTT AGAATGTGAT TTTTATCTCT
504001 TTTTCACAAA CAATACACAT ATATTAATAC CTATACTATG TATGGCTTAT
504051 ACTAATCCCT TGTTATATAG AAAGTTGAAA CATATTATTC TGCCCTCAAG
504101 AGGCTTGTAG TAGAGATGAG TCAAAAAACT GAAACTCTCA GGAAATGAAT
504151 CATTTTGATA ATTTAAGTTT TTGGCCAGGG TTTAATCTTA GAAGTATTAT
504201 TTTTATAACT TTAGAATAGT TTGGAGGCAA ACGTTTTTTA ATCATGCATC
504251 CCCAAACTCT TGTCCTTTCA AATAAAATAT ATTGGACTTA TCTCAGTATT
504301 TTCTAATTAA TATCGAATGA TCATATGAAG GTATCGAGTT ATAAAACATA
504351 GTGAATTATT TGATGCTCCT TGAATTTTGT AGGGCTATTT GATCCTAAAC
504401 TCCTGGCTCC TGACTAGTGT ACACTTTGGA ATCTTGTGTC AGATTTTCAG
504451 TTTTTCCACC TCTTCCATCA GTCTGACTAG CAGTGTGCAA TTATTTTCAA
504501 CTCTCTCTTT GTAGATGCCT CCCCAACCTA TCTTCTAATC TGTTGCCTAC
504551 TACACTATTT TATGAACTTG GAAATCAATA AATATATGTG AAGTAAAACT
504601 GTGAGGTATC AAAGCTGTTT TATAGTATGT GGACCTCAGT CAGATGCCTT
504651 TCTAGAGAAT CTTTTTTATT TGTTTTTGTC TTGCTTTCTA TCGTTCAACT
504701 AAATCACATA ATTGAGACTG CTGTCTAGCT GATTTCAAAT ACATGTGATA
504751 ATATGGGTAC CTGAACTAAG AAAATACAGT GGGAGTTGGA GAGAATGAGA
504801 AAGAATCTAA GAAATACTTT AAAATTATAA GGGACAGGAC TGATCAACTT
504851 GGAAGGCGAA GGAGAGAATT GGTTGAGGGC TGAGTCCAAG GTTTCTTGCC
504901 TGAACATCTC TGAGAATGGG ACATGGGAAA GGGATGATTT TACTTTCTAG
504951 GCAATGGGAA ATGTTCTCAA TATTTTAAAA TGTTATTATG AAGAATAATT
505001 ACATCCATAT AACGTGGATG TATTGTGAAG AGATACTGTG GAAAGGCAAC
505051 CTAATAGCAA ATGATGAAAC TAGTCTACTC CTGTGGGGCT GAAGCCTCAC
505101 AGTAGGCTGT GTCACTGGTA ATAGAGGCAG GATGAAAAAC TTGACTCTGG
505151 ACTTGGAGTT GTAGGAAAAT GCAAAATCAA GGATAACCCT ATGCTTTTAA
505201 ACCCACGTGG CCCAAATGAT AACAATATCA TCTACAAAGT CACAAGTTTA
505251 TGTTCATCTA GAAGATATGT TTCCTCAGCT TTCATTTGTA TCTCATACTC
505301 TTCTGTCTGC ATGAGAATGT GGTGTTGAAA ATGTGAAGAT TAATTAATCT
505351 CCATTATGTG TTGCTAAATG CTTATAAAGT TAAGCCAATT CTGATTTCTA
505401 TACATGATCT GAGAGGAGAA TTTTCCTGTA TTGGTTGTCC ATAAACTTTA
505451 AAACTAATTT ACTGGGTATC ATCAATTCAT GGCTTTGTTG AGATTTGTGC
505501 TATGTTTAAA GAAATCATTC TGTTGAAATG ATGAAGACAA TTTATTTCAC
505551 TGAGCAGCAT TTTTTGTGAG ATGCTTTATT TAAAAATTCA TATTAACTAC
505601 TGTCTTCAAT AACTTTAAAA ATATGTTCAT AACAGAAAAG AGTTAACTTT
505651 AAAAATCTAT TCCACAGAAA ATGACACAGA ATACAAATAA CAGATTTTAC
505701 TTTGAAATGT AAATATAAAC TAGAATAATC TTGATTACAG GGAGACAAAA
505751 TCATATGCCT CCATAGAAGA AAATTCTTTG GTTAAAAATA GCCAAATTGC
505801 CTTTCTCCGA CACTTTCCTA AAGATATGAA ATCTCTTTTT TAAGTATTTA
505851 GATTCCAAGT AAAGCATTTC ACTTTTTTTT TCTTTAGATG GAAACAAACC
505901 ACACTTAATA ATGTCATCAC AACTTATGCC AAACGCTGTT GCTCAGTTAC
505951 AATTTTGCAA TTCTTTTTGG ATAATTGCTT CCTCTTAAGG AAGTATACTT
506001 CTTCCCAAAT CATAGAATGA AATATATCAT TTTAATATAT TTATCTTTGT
506051 CCAAGAATAC AAGCTAACAA TTAAACAAAG GATCATTTCC AATCAGTGAG
506101 TCACAAATAA ATTTTATTTT ACACTATGGA TTTCAGAGTG GTTCTTTTTA
506151 GGGACAAGTT TGCTTTCAAC AGATGCCACT TATATGAGTA AACGATACAT
506201 TTTTCTCCTA CAAAACTAAT GAGAAGGTTC TGCTCAGGAT TGAAAAAACT
506251 GAATGGATAA TGCTATAGAC AAGTTTTCAT AACAGAGACA TTTGTAGCTC
506301 TACTGTATTT TAGTGGAATC CATTTGGCAG GTAACTTCAT GGTTTGCTTA
506351 TTTGTTTCTT TAAGTGTCTA TTTAAATAAA CCAAACTAAT GAGATCTCTA
506401 GCCAAGGAGG TGATCATCCT GTTCCTCCTC TTACTTCTTC CAACACATTA
506451 CATTTTCCCA AATTCCCTGT CAGCTCACTC ACTGCCAGAG GCTGCTTATT
506501 CTTTTCCAAC ACCATTCAGT TTCCCTTTTG TAACAATAAT TACTTCTGTA
506551 ATTTCTTATT CAGTGTCTGT CTTCCCCACT GAACTGAAAA TCCATGAGCA

FIGURE 3SSSSSS

506601 CAGTAACTGT GTTTTGTTCA TCACTGTATA CCCTGTGTCT ATGTTAGTGC
506651 CTAGCATAAA CTAGTTGCTC AATAAATATT AATTGAATGA ACTAATAAAT
506701 TCTTAACCTT AGACTCATAT TTCTGAGCTT TGGTCCACTC AACTTGGTAA
506751 AATGTAGCAG TCTGAATTCC CTAGTAGCTT CTACCTCCCA GAAAGCATTG
506801 TCTCCAAGCA CACAGAGTAA TTGGATTTTT CTGATTAGTG TTGGGTACAC
506851 TCTCTTCACG TACATTGTAT AGCTACACTG ATGGTAAATC TTCCCCACAT
506901 ATCAAGGGAA GGGTGGGAAT GTGGATTACT CCTGAACTTT TCTTACCAGA
506951 ACCATCCAGT GCAAATAATT ATTCAACCCA CTCACTCAAA GGAATATTTA
507001 TTACCATGTA GGCTGGACAC TGTATTGGTT TCCTAGGACT GTTGAAACAA
507051 ATTGTCACTA AGTCAATGGC TTAAAACAAT ATATCACAGC TCTGGAGACC
507101 AAAAGCATGC TCCCTCCAAA GTTTCTAAGA GAGACTTCTT CCTTTTCTCT
507151 TCTTGCTTCT GGTGTCTTAT TCTTTGGCTT GTGGGTTGCA TAACTCATCT
507201 CTGCCTTTGT CTTTACATGT GTCTTTACAT GGCCTTCTCG TCTTTGTCTT
507251 CTCCACTTTT CTCTCTCATA AGGACACTTG TCATTGGATA TGGGACAACC
507301 TGTTTAATCC AGGATAATCA AGTTTCTTAA TTACACCTGC AAATTCCTTT
507351 TTTGAGGGGA GGGGGAAAGG CTGTCACCAT TCACCCCACT ATGGATATCA
507401 TAGTGAATAT AGTTCCTGCT CTCATTGAAT TTGAAATCAA ATGAGAAAGA
507451 CAGATTATAA AAAGTAATTT CAATAAAATG TGATGGTTTT ATTGGTAGAA
507501 ATCTTTTAAG GGTCTTGGGG AACATCTGTC TGGGGACCTA CCCAAATCTA
507551 AACAACCAGA AAAAAAAGTG CTTCCCAAAT GATAAGATAT TCATGGAGGA
507601 GTGATTAGAA ATTGACCAGA TATTAAGAGT TTGGCTCATT CAAGGACTTG
507651 GAAGAAATTC AGTATGCTTA AAGAATGATA AGATGTATCT GAAGACATAC
507701 GCTAGAGCCA TTTGTAGACA GCTTTGATAA CAAAGTTAAG GGCCTTGTAG
507751 TTTATGCCTG AGATGAAGTC AGAGCTCTGT GATGGACCAA CACTAATATG
507801 ATAAAACGCA AAAATTATCC CCATCAGGAC CAAGCTCCTG AGTGTTTTTA
507851 TTTCCATATG GCAAATCTTG TTCTTTCCAC TATTTTGTTG CAGCCTGCAT
507901 GGATAACACA ATATCATAGT ACAATTGCTC TGAAAGATTG TGACAAGAAT
507951 GTTTAATTCA ACATTATCAT TTTACAGACA TGAAATCAAG TTCAAGCAAG
508001 GCTATGATTG TTGTAGGGTA ACCAAAACCG CTAGATCTAG TTAGTTCTTC
508051 TGTTAGGAAA AATGGTGGTT TAAAGTACTG GCAATTGCTT GGGCTTGGAG
508101 ATCGGCAAAA AGAAGTTGGA TTGCCGGCTT TCCCTTGACA AGATATGTAA
508151 CCTTGAGAAA GTAACTGTTT AAACTAGGAA TGATAATAGT ACCTACCTAT
508201 CAAGACCATT GTGAAGATAA TTTTGATAAT GAATTGACGC TCATAGTTTC
508251 CTATTAAATA AATAATGACT GTTGTTCTTG TTGAAGATGA TAATGTTGAT
508301 GAGGTTTTTA TAATCATCCC AGCCTCACAA TCTATAGCAT TTTACTCCCA
508351 GTATAATAGT GTTTCATTAA ATACTCTTAT TAGGAAATAA GAGTATTTAA
508401 CATATTTATT TTCTAATAAG AGTATTTAAC ACATTTTATT CTCCACAGAG
508451 GAGTGTTTAC AGTTCCTAAG TTTAAGAAAC AATTATGCAG GAATATGCAT
508501 TTTTCAAAGG GTCATAACTT AAGATTGTTA TCCAATTAAA ATTTTAATTA
508551 AAACAAAGTT TATAAATGTA ATAACAAGTG TGCAGAAGGA GACATATTTG
508601 TAGAATTAGC AGTTTAGTCA GTAATTATGT ATGTAAAACA ACACCATTTT
508651 TTATAACAAA GTAATCTGAT TTTCAAAAGG CACCCAATTA CAAAATCTCC
508701 CTCTGAATTT TGGACTCAAC AAATTATAGC TACCTAACTA CTATGAAACT
508751 ATATGCCCCT GATTCAAAAT TCTTGAATTA TGCTATTTAT TTTACAGATA
508801 CAACAGTTTT TAAGTAAATA ATGTTTTTTG GGTAAATGCC ATCTGCTTTA
508851 TCTTCAAAAA GATAATGCTT TCTAGAACAA CTATTTCTTA CATTTTTGTT
508901 ATTCAATAAC TTTCAGTGAG AAAATATGAC ATTTTAGAGC ACAACATTCA
508951 TTCCCATGAT ATCGGTGCTA TTTTGAAGAT TAGGAAATTC AGTGAAGACC
509001 TAATAAAAAA CCTTCAGTAC ATTATTTATT GGATAAGATG CAACTATTTA
509051 ACTTGTCTCT GCACAGATTA TGAGTGAAAA CTTAACATTG TAGTACATTG
509101 CTTGAAAATG TCTTGATTAA ATCATAGTGA CTAAGTTCTA ATTCTAAGAT
509151 TTAATACATT TCTCTTACTG AAAACTGAAC ATAAATGACT TCAACTCTTT
509201 TGTTTTTATT TACATTCAGA TTTTTTTAAA AGTCTCTAAA GTGCTGTGAC
509251 TGGTTTCTTA CTGACTTGAC AATAGTGTTG AAGGCTTAGA CATTCTGTTG
509301 TAGATATGTC ATTTTTATGA GAATGCTATT ACTCTGGATA TGAATTTGCA
509351 CATAATATAC TGCATACTCA ATTCCCAGAA AAAGATCTAC TTCTGTGGAA
509401 GCTGTAAAAT ACTCAAGTTT AATAAATTAT TATGTTAGAG ACTTCTGCAG
509451 TTTGCTTCTC AGTTATATAC TTTATTTGAT CCAATTTTCT CCAATAGCTG
509501 ATAAGATTAA TAGATATTAT TTATTTTCAG TAGTCAAAAT AAAAAACAAG
509551 TTTAATTTAA GTTAAGGAAC ATTAAGAGAC TGATTGATTT GGTTTTTTAT
509601 ATTATTGATG ATTAACTCAA TTATTACTAC AAGTTATAGT AACAAAAATG
509651 GAGAAATGAG ACAAAACCCT GAAAGACTGA ATTCTGGTCA TAGTTTTATG
509701 TGGGCTTGGG CAATTTCTTT AATTTTTCTG TGCTTCTGTT TTCTTACCTC
509751 TATTATTGAG GAATTGCCTA TTCCACTCAT TGAAAATTAT ATTTGATTAA
509801 AGCATTATTA ATATAAAAAA TTAGAAGTGC TAATAAATTA ATTTAAATGA
509851 TATATGTTAA AAGATTCCCA GAAGATTAGT AAAACATGCA GCTCATGTGC
509901 TTTTAAGAGA CAGTTTTATG AATGAAAGAA GGAACATGTT GCTACCATAT
509951 ATAATCTGGT CTTTTCTTCA AAAAAGGAAG CTTTTAAACA TCATTTTTCC

FIGURE 3TTTTTT

510001 AATTATTGCT GATTAAACAT CTAAGCACCC ATTATGTATA TCCTCGTGCT
510051 GTGGAGGTGA GAATCCACAA TTTTAGTGTT TGAATTAAGT TCTATGAAGT
510101 ATAAAGAACA TCATTCTTAA AAGGAATTAT ACAGTAGTCT TTCTACTTTG
510151 TGAAAACAGA TATCAAAACA GTCTATAAAG CCTGGTCTAT TGGCCAGTGT
510201 TTAAGAGGAA ATACAGTGAG CAATTACATA AAACAATTCT TTAGCCTATC
510251 TGCTGATTTA GTTTTACAGC ACATACTTAA TCTTAAAATA AGGGGTACTA
510301 AGAATTCATC TACTTTATTG ATCTTTTTTG AAGAAAGAGG ACAGGTTTAT
510351 GTTGTGGGTT ATGGCCCCAA CTCTTCAGCC CTGAGTCAAA ACTCATTTAT
510401 TTTGGGTTTG CTTCATACGT GTCAAATACT GAAATAAAGG CCAAATATAC
510451 TGAGCTTGGC ATCCGTTATT GTATTTTCTA GTGTAAACTA AATTGTAAAA
510501 TGGTTTTAAT AGTGAAATGT CACCCAGGGA AATTTTAATA TTGTATCTCT
510551 GTTTCAGCTT CTGACATGGC AGCAGAACAA GGACAGATTC TCGTGATAGC
510601 CACCGCCGCT GTTGGCGGAT TCACTCTCCT CGTCATCCTC ACTTTATTCT
510651 TCTTGATCAC TGGGAGGTAA CTGAAACATA CCATACTATT TCCGAGATTT
510701 ATGAATAACC ACTCTTTTTA TACATTGTGT ATTCAAATGC TTTTAGATAT
510751 AACAAAGCAC ACCTGAGGTC GAGAGGGATC CCAGAAGAAT CCACTCTGAC
510801 AGTGAACCAT CATTAGTTCT CTGTTTCAAC AGGTCCCTGA ATATGGAAAG
510851 ATCCGAAGAT GACTAAAGCT GTTTGAAAGC TATGAATGAT GAATTTATAG
510901 TCAATAAGTT ACTCCATATT TTTCCTTTAC TATAATCAAA TTACATCATA
510951 AAAAATAATT TTCTTAAAAA ATATTTTAAT GGAAAGTCAG AACAATTTAT
511001 AGAAAAACTC TTTATAAACC TAGTGTTATA GAAATATAAT ATTTTGTCAA
511051 TTAAATATTG AAACTGTCTA TGTTAGAATT ATATTAATTG GTTTTATAAA
511101 TCCAATATTT CTATACTTCA AAGTAATTTG AATAAAATAT AAACTAACAG
511151 TAAATTTAAC ATAGCAAAAG ACCTAAATTT GAATCCTGAC TAACTGGTCC
511201 AAGTGCTTCA CCCATCAGAA CCTTAGCTTT CTATTTTTAT ACAGGTTTGA
511251 TACAAAAGTA TATTAAAACC ATTTAATGAC TTTTTAATAA ATAGTATGAA
511301 TCCCATAATC CAGGTGCTGA TAATACAGAC GTGAATGAAG ATAATATGTA
511351 TAAAATTATA TCAAAGAATA AATGTTATTT CTTATTTAAT CCATGGTATT
511401 TGGCCAGGAC TTTTTCCAGA AATCACAATA TTTTATTCTC AGATCATTCT
511451 AACAAGAAGA TAAAATAGTC TATCTAGATA TCAAAAGAGG CACAAAAGAA
511501 TACCTCAACA GATTTTTTAT AATCAGAAAC ACACATCTAC TGCAATATTT
511551 CACTATCATG ATTTAAAACT GCAAAAAGAA TGTCAGCCAA ACAGTACACA
511601 CCAATGTTGA CTCCAGCTAA AGTACACCAA CCCTGCCAGA AAACATTGGT
511651 ACGTCAGAAA GAGCAGAAAT AATAAACAGC ACCTTCAGTG AACCGAAAAC
511701 ACTATTTGTT TTTAAAACTC TGCTTAGGGA CCAACATTTT ATTAAAATTT
511751 AATCTACTTA AAATTACAGA GGTAATTTTA ATACACATAT GAAAAATTGT
511801 CTACAATTTT GACAGCACAC CAAAAAGTAT AGAACTTGAC AAGTACTTTG
511851 CATGTATCAA ATGTGGGTCC CTGACAAATA TACAACTGCT ATTCAGTAAC
511901 AGTGTATTAG ATATAGTTGT AACAAACCTC CTTTTATAGA ATTTACCGAG
511951 GAAAAAAGCA GCATGAATAT TCTAATGTGG TTGAGTTAAA AATGATGACT
512001 TATTTGTGAA ATTAAGTGGA AAGAAGGCAC TTTACAACTA TGTTTACTTA
512051 AGTTTTTCAT GTATATAAAC AGATATAGTA ATGGTCTTAG AATTAAGAGG
512101 GAGTATTTGG GGGTCTCTAG TTTTGGGGGG TGATTAGCTG ATAGAATAAT
512151 GCCAGCTACA GTAACAAGGG AAAAAAACAG ACATGAAAGA ATGCAGGAAA
512201 TAATGATAAA TTCATCTTAA TACAAGTACT AATTTGGGCA CAACATGTTG
512251 CCACCATCAG GCACTGTTGT CCAGCATCCT CTTAGGACCC TTTTCCTTTA
512301 TTTTTAGGGC AAACCTCTGA CAGCTAACTG CCATCATCAG AGCTTTGATA
512351 TAGCTCATCT TTTATAGAGG ACAGAAAGCA AATTTTGGAA TCTCTAAACC
512401 AATTAACCAT TAGGTTGTAG ATTAAATGTT CAACACTGCA GCTTATCAAA
512451 CATGGCCTAC AAAAACTTGA ATCACTAGCC AGAATAAAGT GATTATAAAA
512501 AATAAACAAA ACCCCTAAAC ATCCTGGTGG AGGTCTAAGT TTTCTGAGAA
512551 AGATTAAAAT TATTCCCATA CTATTTTGGA CTCTGGCAAA GAGAGGGATT
512601 ACAAGACAGT TATGGTTAGA GAAAGAGAAA GAGAAAGAGA GAGGAAGGGA
512651 AGGGAAGGGG AGGGGAGGGG AGGGGAGGAA GGGAAGGAAG GGAGGGAGGA
512701 AAGGAAGGAG AGAAAGAGAG AGAGGAAGTT TCAGTGAGGG TTAATGGCGC
512751 AAGTTTAAAA AAGAAAGGAA AAAAGAAAAT AAAAGTATTT TGTTGTATGT
512801 AAAGTCACAA TGACAATTTG GTTAAGAAAA TCAAATTGCC ACTACTTTAG
512851 CATTGCTACG TGTTTAGTAA ACTTTATTAG GAAAATGTTA AATAGAAGAA
512901 TAAACCTTAC TGTATATTCC TTACCCTCTA TAACATTAAT GCTGCCCATG
512951 CATTTTGAAC TGGGGTCACT GATATCTTTA TAATACTCTA ATTATCATGA
513001 AGGACAATCT GCTTTGGAGC CCAGAAAGTT TATTTAGTTT TTAAAGTACA
513051 ATGGCATTCC ATTGTACTTT AAGGAGCTCT TAACTACAAA GACACAAATT
513101 TATCATGTAA CTATACTGTG AAAAAATAGG TATGATGGTT GATTTTGATT
513151 CAGAAATATT TTTGTTTTCC ATTTTCAAAG TTTCTTTGAA GGAGGGAGTA
513201 ATCTCCTTTT CTTATTATTA TACTTTAAGT TCTAGGGTAC ATGTGCACAC
513251 ATATGTTTAT GGAGGGAGTA ATTTCTTAAA TGTGATTTTA TTTAACATCA
513301 GTATTACATT ATTTACAATA GAAAAAAATC CTCTGGACGT TTAAAAGAAA
513351 TTTAATAATG ATTCACTATA TTGCAAAATT GGATACAGTT ATATGTATCT

FIGURE 3UUUUUU

513401 TGTAGAACAT AAGTTAAGGC CTTATTTTTT CATAGAGTAT TTCAGTAAAC
513451 AGTGATTTAA ATAGCACATA CACATGTGGC AAAGCATTTC ATTAAGGCAT
513501 CAGAAAATAT TTCCTTAACA CATAAATATG ACAAACACAA AAGAAAACAT
513551 TTCAATCTTT GCAGGCTAAA TAAGTATTGC CTAATAAACT TGAGAGTTGG
513601 GCTCAAATAT TATCTTTATT TGGGATTCCT GGAGCAGAAT AGATATACCA
513651 CTTCAAAGGA GAATTTAATG ATGAAGAAAA ATTTGTGCTA AATTATTTTC
513701 AGCTTTCAGT TTCTATGTTT GCCAATTTAT ATTTCATTAG AAATTGCTTT
513751 AACATTCCAT GCAATGAAGA GAACAATTTC AATTACATAA AATAGAAAAA
513801 AAAATATTTT GAAGTATTGC TTAAGCACTT TGGTAGGGGA GCAGTCATTG
513851 GAAAATATTC TATGAAAACT GTAAGACATT TCTGAATAAA TGCTCAACTT
513901 GCCATAGAAT TCGAGGCAAA ATTCCCATTG AAAGACTGAA TTATGTAACA
513951 CAGACGTACT TTGTTTAGCC ATTAGAAATT TGATAAACCA TCAAATCATA
514001 TGGATGTTGA AGAATTTACT CATATTGAAG AAATCTTGAG AGCATGGTTA
514051 TCCAGAGGGA GACTAGAACA TGCCTCTACC AAATTCCAAA TATTAAAAAA
514101 TAAAACTGCT GAACCATCCT GCTGTTTAGC AGTGAAAATG GAAGACAGTT
514151 GTATACATTT CTGAAATTCT GACTCAAAAT GCTTTTTTTA TTTTGACTTT
514201 TAATTTTCTT TTTACCAACT CTAGCTATTA GTAGTCATGT AAGGGATGGT
514251 TATGGCAGAT TATTAAATAT TTTCTAAGAC TCCTATCTTT CGAATCCATC
514301 TACTTAACAG TATTTTATTC TAGGGCTAAT TTCAGTGTAC ATAAAAAACC
514351 TACTATAGAA TATTTTCACG TTATAAAGAT ATTTTAAAAG TGGTCTTTAT
514401 GACAAGAAAT TTGTTCATAG ATTATATGTA TTTTAATTGG TTTTGCATTG
514451 TATGCATCAT ACTTCTTAAA ACAAGTTTTT TTTTTTAATC TTTTTAAAAG
514501 ATGTCAGTGG TACATAAAAG CCAAGATGAA GTCAGAAGAG AAGAGAAGAA
514551 ACCACTTACA GAATGGGCAT TGTAAGTAGC GCAGGGACTT TCTTTCATTA
514601 TTTTGTACTG TTCCAGCACT TCAGGAGTTC ATTCAAACTG TATCTATTGA
514651 GTTGAGAAAA AAAGAAAAAA AAAATCACTT CCAACCTTTC AGCATTAAGA
514701 ATTTTCATCT GGTTTCCAGG TTTGTTGGTG AAAGTTGCAC CTGCTTCTCA
514751 TTAAATAACA TTACCTTGTT CCCAATTCTG CTTGCTGGAA AACACAACAG
514801 ACTGAATTTG CTAAAAATAA TAGTTGACTG ATTTTATCAA GTTATTTACC
514851 ACTCACAATG GCTCTAAAAC ATGAGTTGAT TTTATCTAGT GGAACATTAG
514901 ACATAGAAAT AAATATTAGG GAATCTTTAT TCCTTCTTGT AGGGACTGTC
514951 TTTTAAATAT ATAACAAATC AATTTACAAT TCATTAATAC TAAAAAAGAA
515001 TATCAGCTCT TTAACTCTTA GAATATGTAT GAAATCCTTG GGCTGACTAC
515051 AAGGTTATAT TCATTTGAGA GATCTATTCC CAAGCAACCT ATAATTACCA
515101 CTATAGCTGG TTTGATAACT GACAACTTCT CCTCCTCAAC ATCCACCTCC
515151 ACCTCCACCT CCAAATTGCA AACTACTTCA GCAAGACAGT TTTTCTATTG
515201 TGAGACACTG AATTAACAAG AAAGGGATGT TCTCTAATTA ACCACAGTGT
515251 AGAGATAATA TGCAAGGCAA CTTAACTGTT TTATCTTTTA TTTCAAATTG
515301 AGCAAAAGAT AATAAAGGAC ATTTCAATCT ATACCACCCT CCAGGAAAGG
515351 GAAAGGATTT AAGTGAGGAA CTTTTATTTT TTATTATTAT TTTTTAAGTA
515401 TAATTAGAAT TTTTCTTTTT TTTCTTTCTT TTTATTTATT TATTTTTTTT
515451 AGTATTTATT GATCATTCTT GGCTGTTTCT CGGAGAGGGG GATTTGGCAG
515501 GGTCATAGGA CAATAGTGGA GGGAAGGTCA GCAGATAAAC ATGTGAACAA
515551 GGGTTCTCTG GTTTTCCTAG GCAGAGGACC CTGCGGCCTT CCGCAGTGTT
515601 TGTGTCCCTG GGTACTTGAG ATTAGGGAGT GGTGATGACT CTTAACCAGC
515651 ATGCTGCCTT CAAGCATCTG TTTAACAAAG CACATCTTGC ACCGCCCTTA
515701 ATCCATTTAA CCCTGAGTGG ACACAGCACA TGTTTCAGAG AGCAAGGGGT
515751 TGGGGGTAAG GTTATAGATT AACAGCATCC CAAGGCAGAA GAATTTTTCT
515801 TAGTACAGAA CAAAATGGAG TCTCCTATGT CTAATTCTTT CTACACAGAC
515851 ACAGTAACAA TCTGATCTCT CTTTCTTTTC CCCACATTTC CCCCTTTTCT
515901 ATTTGACAAA ACCGCCATCG TCATCATGGC CCGTTCTCAA TGAGCTGTTG
515951 GGTACACCTC CCAGACGGGG TGGCGGCCGG GCAGAGGGGC TCCTCACTTC
516001 CCAGATGGGG CGGCTGCCGA GCGGAGGGAC TCCTCACTTC TCAGATGGGG
516051 CGGCCGGGCA GAGGCGCTCC TCATATCCCA GACGGGGTGG CAGAGCAGAG
516101 GCGCTCCCCA CATCTCAGAC AATGGGCGGC CGGGCAAAGA CGCTCCTCAC
516151 TTCCTAGACG GGATGGCGGC CGGGAAGAGG CGCTCCTCAC TTCCCAGACT
516201 GGGTGGCTGG GCAGAGGGGC TCCTCACATC CCAGATGATG GGCGGCCAGG
516251 CAGAGAGGCT CCTCACTTCC CAGACGGGGT GGCAGCGGGG CAGAGGCTGC
516301 AATCTCGACA CTTTGGGAGG CCAAGGCAGG TGGCTGGGAG GTGGAGGTTG
516351 TAGAGAGCCG AGATCACGCC ACTGCACTCC AGCCGAACAA TTTCCTCATG
516401 AAGTACTGGA AAAGACAACC TTTTTCTCCA TTACTATTTG GACTTTTAGA
516451 TCACGTACAT AACCAGGAAT TGAATAAATA ATGAATGTTT TCATAAAGAG
516501 TATCCGTCTT GGAGGGAGAT TCCAGTTGTA GAGATGTTTC ACTTGTGCAA
516551 AATATCCAAC ATAGCTATTC TGAGAAGGAG TTTCTACTCC CTGAAATTTT
516601 TTGCTGTGGG TTTTATCTGT TCGCCTTTCT CCAAAATAAT ACAGGCTTTC
516651 CTTTGCAGTT AAAAATATTT CAGAGGCAAT AAGGAAGGCA CAAACCATAG
516701 TTCCGGTTCT TCCTCCGGCG CGGGGCTAAG TGCAGGCCCG GGGGTCCCTA
516751 GAGCCGCCGG GGCGCGGCGC GTCCGGCGCT GGGGGACTGT TGGGTCAGAA

FIGURE 3VVVVVV

516801 AGTCTTCAGG GAGCAGCTGT TGCGCCCTCC CTAGGCCCGC CGCTTGGAGA
516851 CGCCCCGCCC CCTGCCTTCA ACGGCCGGCC CGGGGCCCGC CCCGCACCGC
516901 CCCGGCCCCG CCCCCTGTGA GGAACTTTTA TACAGTAAGT CTGACTCTTA
516951 CTGCACTGGC AGAGCTGAGA GAACTGATAT CTGGCATGGG ATAACATGGA
517001 AAGGCTGTAA ACAGATTGCA GAAACCTGGA TCCAGACACC TGGGCTGATG
517051 ACTTAACGCA GGGCAACCTT AAGATTCACT GCAGGGCATT TAGTACTGCT
517101 ATGCAGAGGG AAAAGGTGCT CCTGAGGCAT TTATTATCTG TTTTCCAAGA
517151 GGTAGGTTAG CATAAACCAA ACCAGATGGG CCCAGCATGA AGCGATGAAA
517201 ATAACTCGAG ACAGCCAAGG AGGTAGAAGA AAGTTAACCA ACTGATGTTT
517251 AAGAAGACGT TGATAAGTTT AAATTAGTAA CCAGGTATTC AAAATTGGAA
517301 TTCAGTTTGG TTGTTTATTT TCCTCTTTAC TACACATATG TTTATAAGAA
517351 AAAAATGTGA TATTTACTGA TCTTATTCTA TAGAAATGTG TACCACCTTA
517401 AATAATTGAA TAGTTTAATA GTTAAAACCA CATATGAGTT AATAAATGAT
517451 GCTTGTTATC TGTGCCTAGC ATAATATTAT CAACATGACC ACAGATCTGA
517501 TTAGATATCA CTAATAATTA GTAGTGGCTA CTAGGTTTGA GGTTATAGAA
517551 CTCAGTCTGA AATCACAAAT TCTACTAAGT TGTTATGAAA ATATCATATG
517601 GAATATAAAA TAGAGGTACA AACTATCTGT TCTCATTTTC TTCAATGGAT
517651 GCTTTGAGAA GTCAAGGAAA GCATGACATG TTAAAATTAG TGTCAGGTCT
517701 GGGTATACCT GGAAATATGC TTTTCTGGTG CTAATTTGAG AAATATTAAT
517751 TTTCTCACGG TCCATATGCA GCACTAAGAA GACAGAAGAC AAAATGTGTA
517801 AATGAAGGCA ATGGGCATAG AAGGACTAAG GAAGCAAATT GCTGCTAATA
517851 TTGGGCATTT CAGCACCTCC TCTAAACTTT ATTACCTTTT GTTTGTTTGT
517901 TTTTGATTTT TTTGTTTATA TGTTTTGCAA GGAGAGTCAA ACAACAGTTA
517951 ACGCTGGGTA TTATAAGACT TTCAAAATCT AAGAAGCAAC AAAACCAAAT
518001 ACCATCCACT CTGCCACAAA TTTCACATTG GTCTTTTAAT CCCTACTAGT
518051 TTGTATTCAA TAAAGGCTCT CTGTGTGATT ATTGCCTGTA AAACCATACC
518101 TAAGATATTC GGAACGATAG AAAGATATAT AAGAAATGAC CTCCTGTCTA
518151 GAGATCTAAA ATGGAAAATG GAAATTAATG AGCCAGCTTG GTGGCTTGTG
518201 CCTGTACTCC CAGCTACTCA GGAGGCCGAG GCAGGAGGAT CACTTGAGCT
518251 CAAGAATTCA AGGCCAGCCT GGACAACATA GCAAGACTGC CATTTCTCTA
518301 AAAAAAGCAG AGAAATAAAT AAATGATCAA AACAGAGGGA TATTCATGGG
518351 CAGAGGCAGT CTATGACTTC TTCGGATACT CACAAATGGA CATACAACCA
518401 CACATTAATG TTTTCTAGCC ATCCTTTCTC ATCATCCTAA CTGCCTGTAG
518451 GCTGTGAGCC CTCCATTCTC ACCAATGAAG CTCAGCAGAT ACACAACCAA
518501 TGACCAGATT TTGGCCTTTG ATTTCCATCC TTCCCACCAG GATAGACAAG
518551 CTGATCCTAT TCAGGACTAT ATGCAGTCAG TCCATGGAAG CCACTACATG
518601 AATACAAAAA ATGGCCATTA TCCCTACTGG CCTTTCTTGT TTCTATGCCA
518651 TGAAGTCAGT TCTTTACTGC TTGAGGTTTT CTGGAAAAGG GGGAGACCAC
518701 AGGAATAGGG CATGAGTTCA TGAAACCTAG TGCCGTAGAG TACAAAGAGT
518751 CCAGGAGGAA CCTAGTGGGC TTCCTTGCTT TGGAGGGAGG CTTATGCCTC
518801 ATTTTCCCCA TTCCCCAAGC TAGAGCAGAT GTGGAATGTT TTGGAAGCAT
518851 AGTGAATGAG TGAGCTGATT AAACATTTTA TAGAAATATG AGACATGTGT
518901 TTTCTGGAAC CTGTCAGCTC ACTTTCTAGA AATCCACCAG GTCATTCTAC
518951 ATTAACAGTG AGGTAAATAA ATTTTTGACC CTCGTAGTCA AAGCTTTAAT
519001 ATGGGACAGG AAGAAAAGAG AGACTTTAAA TCATTATCAA GACTGACTAC
519051 TTCAGTATGT CATTTCCGGT TTTAAATGTT CACAAGATAT AGACCACTGA
519101 GATACTCAAA CTAAATCAAT CGTTTTGTTA TTGTTGTTGC AGTGCGCTTC
519151 CCGGGAATTA AAACTTACAT TGATCCAGAT ACATATGAAG ACCCATCCCT
519201 AGCAGTCCAT GAATTTGCAA AGGAGATTGA TCCCTCAAGA ATTCGTATTG
519251 AGAGAGTCAT TGGGGCAGGT AAATGTCAAA TCTACACTTT TGAACAAAAC
519301 ATTCCTTAAT TTCTTTGTAA CTGGTTTATC AACATACTAT CTTAAATCTT
519351 GGCAGTTTTG GTCATTGAAA AGTTTTAACA AGTGAGAAGT AAAGTGATCT
519401 TGTATATGTT ATTTTTTTTA AGTATATTTA GTGTCCATTT GTTTCCAAAC
519451 AATGACAACA TTCACAAAAG TTACTTTTAA CATTCTATAG TCTTTTTTTA
519501 TAGTAGAGAT AAATTACAAT GAAACTATAA TTTTTAGGGG TTTGTCATAA
519551 GGTTATAGAT TTACTTGAGC GCCAACATGT ATAGACATAC ACTATAATTA
519601 TAATAGTATT TAAAATGATG ACCATGAGCC TCTGCAAGAC ACAGAAAAGT
519651 TCTGAGAATC ACCAAAGATA AAATTTGGTT CAATGTAGTT TTAGGTCATT
519701 TTAATGCAAA TTAATATTTC TCCCTATGTA GAATTTTCCA ATCTTAGAAC
519751 ATTTTATTAT TCAACTATCC TGAATAAATA CAAATTTCTT GTAAATCACC
519801 CCACAGGAAT TTATGCTGTA CATTAGTTAA GGCAGAGGCT AAGCCAATGT
519851 AACAAACAGA CTCCAGAATA CAGATTTATT CCTCTTTCAG ATGCTTGACC
519901 CAAGGTGAAT AGTCCATGCT GGCAGAGGAG CTGTCATTCA GGGGGACTTG
519951 CAAGGCCCAA GTTCCTTCTG TTCTTGGCTC TTCCTTCCCC TAGCATGCCA
520001 TCCTCCTGTA AATGACCAAA GCTGGGTCAC CAGTACATCT GCCTTCCTGA
520051 CTGTGAGAAG GAAAAGGAAA TAGTTCTGTC TCTCTGGTTT TGCTTTTAAG
520101 GCAATCACCT GAAACTTCCA AACACAGTAT TCACATCTCA ATGGTCCAAA
520151 TAACAATAAC ATGGACATAC TTAATTGCTA GAGAGTTTGG AAACGGAATT

FIGURE 3WWWWWW

520201 GCCGACAGCT GCCATGCATG CAGCTAAAAT GCATACATTT ATGCAGGGGG
520251 GCTGTTTTCC TAAAATAGAC AAGGGATATT GGATCTTGAT GGGGAACATA
520301 GGTCTCCTCT AGATGCTGGA GATTTGTTTA ATCCTTTGGA AAGAGCAGAA
520351 CAGATGCAAG CATGGCCATT CCAGCCAGGT GTCATGTCTT TACAAAGGCC
520401 AAAAGAAAGC AGCTGATGAT CCTCTGTTTC TTTCAAAGTC CTTTTTCCTC
520451 CAGAAGGACA AGCTACATAA TTTGCAGGGC CCAGTATACC CTGAAATATA
520501 CAGAGTCCCT TGTTAAAAAT TTATTAGTTA TTTCAAGACG GTGACAACAG
520551 AGAACTAAAC CAACTACAGG GCACACCTAA ACTCAAGGCT GTACGTGACT
520601 GCACAAGTTA CATACTCATG AAGCTAATCC TGTTTCCCGG GTACACAGAG
520651 AAGTAGAACT ACCTCAAGAA TTCCAGGCAC ATTTGCAGAG AGTTCTTCCT
520701 GATTTCACTC CATTCCCTAG GTACCATAGA TCACCTCATC TCCTGCATGG
520751 CTGGGTCTCC CTCTGAAAGC TGCCACAAGG GCCTTTATGT TCATAATCTT
520801 TATGTTCTCA GCCAAAGAAG CTGCCTTATC AGAAAGATTA AGGACCTGAA
520851 ATGGAACCAG ATTCTCTGTC TTCTTCCACT GAACAAAGAG CACATCAGCA
520901 GGCATAACTG AGAAGAGTGA TTGAATTATA TTCATTTAGC TTTGGAGTTT
520951 GTTTTCTTAA GACAGCAAAG GGATAGAGAA GAGAGGAGGT TGGATAATCT
521001 CCATTGCACA CGATGTTTGG CTTTCTTCTT CTTGCACCTG TGAAAAACTG
521051 ATATGTCTTT TTATACTGCC TTGTCCAATA CTCACATAGA TACAGGAGAA
521101 GCATTTTCTG TTTTAGCCCT TTGTGCTACA GCATAACAAA ATGCCAGTGT
521151 CTGAAATCAT AATGTTGAGA GATAAAATCA AGTATTGAAG TATAAACAAT
521201 AAGAAGAAAT AAAATGTTTC TTTTATTTTT AGATATTTTT TCAAGTAAAA
521251 TATAAATTGT TCTCTTAAAA AAGTATAATT GATACTGCAA AAGCAAAAAA
521301 TAACTACTAA AGAGATTATT TTAATTTCAT TTTTCCACCT GCTGTCCCTG
521351 AACTCTAATA AGTCATAATG GCGTTTATCT CATTTGGCAA AGACAGATTA
521401 TCTAAACCAT GTAGTTATTC CTATAGATTG GGGTCTCTTT TTAAATCTTT
521451 ATTCATCTTT GATTGTTTCA GCTTTCAAAC AATATGCTAA GGGTCCTTTT
521501 ACTGTCCATA TTCAGAAAAA TAACAAAAAT AAAACTGGTA TGTGAGACAA
521551 AAGTATTATA ACCTAACTTG CGCCCCTGGC CGTACTGCTC TGTTAATTTA
521601 TTCCTTTAGA TCATTGTTAT AGCCCTTTTT ATGCTGCTCT AATAGAATGC
521651 CTCACATGGG GTAGTTTATA ATGAACAGAG TTTTTAGGCT CAAGGTCCTG
521701 GCGGCTGAAG TCAAGATTGA GGGGCCACAT CTGCTGAGGG TCTTCCTGCT
521751 GCATCATAAC ATGGTGGAAG GCATCACATG GGTGAGGGAG AGAAAAAGGG
521801 GGCTGACCTC TCCCTTTTAT GAGGCTGCTG CATTAATCCA GTCATGAGGG
521851 CTGAGCCCTC ATGATCTAAT TACCTCTTTA AGGTCCCACC TCTAAACACA
521901 GTTGTATTAA GGATTAAGTT TCCAGTGTGT GCACTTGAGG GGACACATTC
521951 AAACCATAGC AGTCATGTTT CTAAAACTTT ACTTTTGTGA CTGTGTGAAG
522001 TGTGAACGTA TTCCATAGCA GCAGTGTGGA CAAAACATTG CTCAAATTGA
522051 AGAAGAACCA GTCGTGTAAC ATCTGTGTAC CACTGGTTAC TTTCCCAATT
522101 TGTAACTATA AATATTTTCT TACATTGTTT TGTATCCTTT ATTTTCTTTC
522151 CCCAGCTATT GATTGTTTCT TCTGGGACTC TATTTCTTCA TCATCTTTGT
522201 CTGTTAGGTA GTCCCCTTGG AAATGTAAAT TAAGTGACTT AAGTGGTAGT
522251 CTAGATGCTA GACAGAGGTG AAGTGAGGTA GAGAAGATGA GAGAGGCCAG
522301 ATATCAGGTT GTGACAATTG TCAAGTGCAG GATATTCAGG CAGAATTAAG
522351 GCATTGACAG TAGGAATGGC AAGGAGTACT TAGATTCACA GTTCATTTCT
522401 GAGGAAAAAT GTACGAGACC TCTGTCTCTT ATAGATGCAA GACATGCATG
522451 CAAAGCAACA GTTAAGATTA CTTTTCAGAT TTCTAGTTGG AAAAGCACAA
522501 TATACAATCA TTAAATCTTT CTTAAATGAG TTATCAGAAA TAAATGTAAA
522551 ACAGCCACAT TAACATTTTC ACAAAAAGCA TGATATCACA CCTGACCTGT
522601 GACATTTCTT ACCACATTCA CTGAACAATG TTTGTTAGAT GGCTAATATT
522651 TACTTGTAAA AGATAATGTG CCACTTAATC ATTTCATATT AAATCACTAT
522701 GCTCATTAGA GATACATGTA TTCAGGCTGT CTTCCTCAAT CTTTGTCCTG
522751 AGATTTTCAA CTACTAACCA TCAAAATACT GTGCAACTGA ACCATAAAAA
522801 TTTAATTTTT CTGTACATAT ATTCTTAACA TTCTCCTTCT TTCCCTATAA
522851 ATTTCACTGG TTTTTTATAA GTTTTCTAGG GTACTTTTTT TGTGTGTGTA
522901 TCACTGTTCT ATTTAATACT GGCAGCTTAT CTTTGTTCAT CAATATTGGC
522951 CTGAATTTCC ATGAAAATGC ACATTTCCAT TTAAATGAAG TGAGCAGCTC
523001 TGTTGCATAG GAGACTATCA AGATCATCTA TCTCCTTTGG CTTTTTTGCA
523051 CTATAAAATG AAATTCTGTG GACAGAGGAC TGTAAAACAG AAACTCCCAG
523101 GCTAAAACAG CCAGGTCAGA TTAGGGGAGA ATCATTATTT TATACATATC
523151 TTGCAAGATA TGAGAAAACG GTAAACAATT TTAATCATGG TCTGAAAAAG
523201 TCATTGAAAG GTTGTCCCTC TTTCAGGGTA CTACTAAACC TAAACCAGTA
523251 TAAGAACAAC TTGCCTGGCA GAGTATAATT TTGAAACATT ATTCCATTGA
523301 AAAAATGATT CTTGTGTCGC TAAGCCCATA GGGCACCCTT CTTAAATTTG
523351 ACCTTCCCTG TTTCCCTTGT CTCAATGGAA ATACATAATA TCTTCCTGTC
523401 ATACATATTC TTTCCCTTTA TCTATATGAA ACTCATTATG GCCTCCACTA
523451 TCAGCCTTCT CTTCTGGCTT AGAGTCACCA AATTTTTTCT CTTTCTAGAA
523501 TAGTCCAGGA AGTTTTAACT GTTGGTTTCT CAGCAGTTAT CTGCAGGTAA
523551 AAGAATGTCA AAAGGACAAC AAGAAGGATA TAAAAGTGAG TGTCAAGCCT

FIGURE 3XXXXXX

523601 AATATTTCGA TTCTGTTATT CCGTCTTGTT TGAAATCACA TTTCCCCTTG
523651 ATGCTATACA AGGCCTAATG TTCACTTCAT GTGCCTCTCC TAATTCCCCT
523701 GCCACCCTCA ACCCAGCAGG CCTCTATTTT CTACTCTAGA ATATATTATT
523751 TTTTAGTTAT CTTAAAGAAA CTGTATTTTT GTTTGTCTTT TACACTTGTG
523801 TTATATATTC TTGTAGCATG ACAATGACAA ATGTAGGCAA TATTCCAGAT
523851 GTGGTTTCAC AATTCTCTTT ATATATATAT TTTAAAACCT TGTGTTTATG
523901 GCTCATTTTC TCTATATTTA GATGAGATGA CTTCCTTAGA AATGAGATTC
523951 ATTCTTGTCC ATCAACTTAA AGGATTTATG GTAGAGGTCA CATTCATTTT
524001 CTTGTGTATT CTTGAAAACT TTGCATGTTG AGTAGACTGA GAATAAGATC
524051 AACAACAGAT TTTGGCAAGG CCTTTGTGCT TTTACTCAAT AATTTCAGAG
524101 CTTTCTAAAT CAAATGATGT AATAAAAGAT CAGCTTTACC CATTCTCCAT
524151 CTATATTATG ATATGAATGA AAAAGCAAAG AATGAAGCAA GACAGACTCA
524201 GATATGAATC ACAGCTTTGC TACTAGCTCA TTCTGTAAAC TTTAACAATT
524251 TAGTTATCGT TCAGAAATTT GGGTCACTCC ATGTATAAAG TAGATTTATA
524301 ATAACAGCTA TCTTACAGGA TTAATAAAAG GATTAGAAAT GACTATTAGA
524351 TTAAAAAATA AATACAGTTT CTACATTCAG TTTTGACTGC TGAGATGAAT
524401 AACACTTATT GCCCAACCCT CAATATACTT TGTGATACGA ATATCTGCCC
524451 ATGCAGAATT CAACAGTCAA TGCCTTAGGT AACTGGAATA ATATTTATGA
524501 TTTTCAGAGT TAGTTGAAAA TTAGTAATTG AAATGAAATT TTATTTTTGT
524551 TACTACATTG AGTTATATCC ATGTCAACAA ACTCTTTTTC TTTTTAATTA
524601 AAGAAACTCA AGGCAGGGCA CGGTGACTCA CGCCTGTAAT CCCAGCATGT
524651 TGGGAGGCCC AGGCGGGTGG ATCACGAGGT CAGGAGATCA AGACAATCTT
524701 GGCTAACACG GTGAAACCCT GTCTCTACTA AAAAACACAA AAAATTAGCA
524751 GGGCGTTGTG GCGGGTGCCT GTAGTCCCAG CTACTCCGGA GGCTGAGGCA
524801 AGAGAATGGC ATGAACCCGG GAGGCAGAGC TTGCAGTGAG CCCGAGATCG
524851 CACCACTGCA CTCCAGCCTG GGCGAAAAAG CGAGACCCCG TCTTAAAAAA
524901 AAAAAAAAAA GAAACTCAAA ACTTATTTTT TTTATATTTA GGAGGTTATA
524951 TTTGTCAGGG AATGTTTATT TTTTGTTAAA AAACTCAACA AGTCTTAAGA
525001 TGAGAATCAA AGGAAAAATT ATTTAAATTC TTAACGTAAA ACTATTCTAC
525051 AGTAGTCTAT CAATTTATTC TTGGTACATC TAAGGAATTA GTAGATTTAC
525101 TGTCAGGAGC AGGACTGTAT ATCAATTTAA TAGACTTTCA ATTAATTTTT
525151 GTTAATTTCA TGAGTGTTTA CCTGCATTTC AACACCGTAC ATCTTATTTG
525201 GAACCATTTA GTACACATTT TCTATCTTAT ATACAGATTT CCAAAACTTG
525251 CAAGTTGCCT CATCATAGTC ATTGTTTGAT AAATGCTTGT TTAATAAATA
525301 AATAAAATTC TTAAACTAAT TTAAAAAAAT AATGAGTAAA TAAATGAATG
525351 ACAAAAGGAT ATAGAATTAT TCTAAGTAAT GATTTTACGT GACTATGTTT
525401 ATCTGGTTGC CAACAAAAAT CTTAATGAAG TATGACAATA TAAAATTAAT
525451 TGCATAATAT GTGCAAATAA AAATAAGAAA AATTCATAGA GGACATTTGG
525501 GAATTACAAT TGTTACATTG CTTTATATTA ACAATTTACT TGATAGACCA
525551 AAATTATAGA ATTTATTATA TGCCTTTGCA CTTATATAGT AAAATACAGA
525601 ATTATACAGA AAATATTACA TTGATATTTT ATTTTGAATT GAGTTTATGT
525651 AACAGGGGAA GTAATTTTGA AGAGTTGTTT ATAACTTACA AAGAAGTTAT
525701 TTTTCAAATT TGTTTTTATT TTTTTCTTCT AGTTTGTGTA TTGCTAAAAT
525751 ATTAGGTGAA ATGAAGGAAA TTTGATCCCT ATTTTCAAAA GAGTTCTCCA
525801 AGGATGTTAG CAAGACTGGG TACATCTTAG AATGATGTTC TTTCTTATGG
525851 CTAAGAAACA ATAGATGAGA AAGACCCACA TATCGACAGC AACAACTTTT
525901 AGCCCTTATA TTTCTAGAGT ATATTAGTTA TCTCTTGCTG CACAACAAAT
525951 TACCCTAAAA CTTAAAACAG GAACATTACT ATCTCACAGT GTCAGTGGCT
526001 CAGGATTCAG GAATGGCTTA GCTCCTGCAC AGTTGCTCAC AAGGTTGCAG
526051 TCCTGGTGTC AGCTGGGACT GTGGTCTCAA CTGAAGGTCA GCTGGGCAAG
526101 GATCCACATC CAAACTTATT TATATAGCTG CTGTCAGGAT ACAGTCCTTT
526151 GAGGGTTGTT GCACAGACAG TTTTAATTCC TCACTGCTGT TGGCTGGAGA
526201 ACATCCTCAG ATTCTTACCA TGTGGGCATC TCCAACGTGG CAGCTTGCTT
526251 CATCAAAGCC AGCAACAGAG TCTGCTAGTA AGACAGAAGT CACAGTGTTT
526301 TATAACCTAA TCATGGAAGT GACAGCAAAT TACCTTTGCA CATTCTATTG
526351 ACCATAAATA TGATACTAGA CCCTCCCCAC ACTGAAGGGA AGGGATCACA
526401 CAAGGACAGG AATACCAGGA TGCAGGGATC ATTGCAGGCC ATCTTAAAAG
526451 TTTGCCTACT ACAAATAGTA TTGTTTCATT ATGTTTGGGG CTCTAAGGTG
526501 GTCCTAATTA GCCAGCATTA CCAGGAGTGA TTTCTCCCCT TCAGTCCAAT
526551 TCACATCAAA GATATCAAAG ATGAGTCTTA GACACTCTCT GATACTCAAG
526601 CAGTTTATTC TGGCAGTGCT CTTGTAAGAT GGATAGTGGG GAGCAGGCCA
526651 GTGGCATGGG CCAGGTACAG TCGGGGGGTC AGATGATCAA CTGACCAGGA
526701 GGGTCTCTGT CTGGAGACCA TTCTCAGAGT TTAGGAAGTT CCTCCCACTT
526751 TCTTATACCT GTATTCAGTG TGGGTCAATT ATTAGGTGTT TCTTTCATAA
526801 AGGGAGTGTA GTCTCTCCTT GTAAGGGTAT GCTTTTTTTT TTTTTTTAAG
526851 GTTTATGAGA GTTGAATCTG TGCTGAGATG GCCTTGTGTA TAGGGTATCC
526901 AGGGTTTTTA GGTCTCATTG TCATAGAGAC CCAGTCATCC CCAGGCCTAC
526951 TTGCATCATA CCCCTAAGGA CACATAATGT CGGCCCTGTG AGTTGTTTGA

FIGURE 3YYYYYY

527001 GTAGGCCATA GGGCTGTCAT TAATCCCACA GCCACCATGT GTTTGTAGGC
527051 AGTGTTTCAA GCAGAGAGCA AGAGTTGTAA GGCCACTTGA GGTCTTGTCT
527101 CTGAACTTAA TTCTGACACA TACAGTTGAT CAAAGCAAGT CACAAAGCCA
527151 GACCATATTT AACAAGGTAG AAAAATAGAT TTTACTGGTC AATGGGAACA
527201 GCAAAATTAC ATTGCAAAGT GGCATACATG TAGGATAGGG AGGAATTCAT
527251 GGCCATTTTT TTACAATCTA CCACATAGCT GATAGATTTT TTTAAGTGAA
527301 TCATTATTTT TTCAAGCTTA AAGTGAATAA CAGATTATGA ATTCATTTGC
527351 TATTTTGTCT CTAAGACTAT TTTTGCTTTG CACCCCCTAA TGAATGATAT
527401 TAATGTTTTC TTAATACTCT TAGTTAATCA GCCTTGGGTT AGGTATTAAT
527451 AGGCTTACAA AAAGGAATAA TGAGCTGGGC ATGGTGGCTC ACACCNNNNN
527501 NNNNNNNNNN NNNNNNNNNN NNNNNNNNNN NNNNNNNNNN NNNNNNNNNN
527551 NNNNNNNNNN NNNNNNNNNN NNNNNNNNNN NNNNNNNNNN NNNNNNNNNN
527601 NNNNNNNNNN NNNNNNNNNN NNNNNNNNNN NNNNNNNNNN NNNNNNNNNN
527651 NNNNNNNNNN NNNNNNNNNN NNNNNNNNNN NNNNNNNNNN NATGGAAAAG
527701 CATTAGAAGT GGTAGAATAA ATGGTGTGGA GATTAAGAGG AATTTAGGAC
527751 GTTTTCAAGT ATTTAGAGCT TGATGACACT GGGATCTTTA TTATATCTAA
527801 TTTCTCTTCA AAACATAAGC TTTTCCTTTT TTTTTTTTTT TTTGATGTGA
527851 ATGTAACTCT AGCCCTGCTT TTTGGCTATG AATAATGGCT AGTGACTTTT
527901 TAGTTTGTTG ACTTTTTAAT GACAAAGTTT AAAGTGATTA AAGAAAAGAG
527951 GAAAGATGTT TTACTTTTAT TGGGCAAAGA AAAGTAAAAA AGAGTATGGA
528001 TCTGTATGTG TGTGTGTATG TATACATACG TACATGTAAA TGTGTTTGTG
528051 TTTGTATGTG TGTGTGTGTG TATACATACG TACATGTAAA TGTGTTTGTG
528101 TTTGTATGTG TGTGTGTGTA TGTGTGTATT AGTCAGCTTC ACTGTCATAA
528151 CAAAATATCA CAGATTGGGT GGCTTAAAAG GCACAAATTT ATTTTCTCAC
528201 AGTTCTGGAG GCTGGAGTTT TAGATGGGGT GCCTACATGG TCAGGTTCTG
528251 GAGAAGCTGT CTTCTGGATC GCAGAGATCC ACCTCCTTGT CCTCACATGG
528301 CAGAGAAGAG ATATATCTTC CTCTTCGTAT AAGATCACAG TCTTTATCAG
528351 ATTAGGGTCC CGCTCTGAAA ACCTCATTTA GCCTTAATTT CTTCCAAAAG
528401 ACCATATGTC CAGATGCTGT CACATTGAGT TAGAGTATCA ATGTATAAAT
528451 TTTGGGGGGA CACAATTTAG TCCTCTGTGT GTGTGTGTGT GTGTAGTGGG
528501 TGAGGAAGAA AGCAAGATAT TACCTGATGA AAGATTTACT CACTGTTATC
528551 CAAGTGTCTT CATGAGTAAA TTTTGAATGA AAGAATAAAA ATTGTAAATT
528601 CATAAAGGAT ATGCCTGCTA GGTTTGACTT ACTGGGAGAG CTCTGTCTGA
528651 ACTTAGAGCT GAGTTTAGGC TGAGAGCTAA AGCAAACTAT CTCGTGGTTA
528701 CCACGTGTCC AGAGAGTGGT GGAGGCACAG GGAAACAGAG AGAGGAGCAA
528751 TAGGTCTCCC AGAGTAAAAT CTATAAAGAT GGTACAATTT CAGTTACTTT
528801 TCAGATAATA TGCTGATGTG ATTGCTGTTA AGACTATAAG AAAGATTTCA
528851 AAAAATCAAT ATGAATGCTA AAAATCAAAC TGTTCAATGT GCAATTGAAG
528901 CCTAAGTGCT TTGACCAGGA TGTACCTATT ATGGGTTATC TTTGTAGTAG
528951 GTTCTTCCAA CAGATGTTAG AACCTTTTCT AAAATCAGGT ATTTGACATT
529001 TTATCACAAC TTTTATTAAC ATCAATGTAA CTTGTGTATC CACTGTTCCC
529051 TGATTATAAT GGAAAAGTAC CTTAATTTTA TCCGGAAATA ATATTTGTGT
529101 CATAAATAGG GTTTCTTCCC CAAAAGTTAT TTCCGCCTTT TATAACCAGT
529151 TAATCTATCT CTGGTTAGAA TCTTATAAAC TTTCCTCGCA GTAAGTGACA
529201 CTTTCTAACC TGTCTCGTCT TTACCTGATC TTGTCCCTAA AATTTGGAGT
529251 CATTTTATAT TTGTTCTTCA AACATCTCAT CCACTGGGGG AGAAAATTCA
529301 ATTTAAATTT TGAGAACAAG AACTAGCCAA TTTACCTTCG TGAGCTGTAA
529351 TTTCCCTATC CGTGAAATAA AAGTAAAATA CCTTTACTCC TTCATGATTG
529401 TTGTGAGAAG AAAATGAGAT AAAGTAGATT CTATCTGACC ATCCAGCATT
529451 TATCAGAACA CCACCAGTGA AAGTGTTCAC TACCTCCAAG ATAGCCCATT
529501 CCCTTGGGAA CAGTTCCAAT AAATCCAGGA TATTTGTGAG TAAAAAAAAA
529551 AAGTGCTTCC TTATAACTCC GTACATGATC TTACAACACT GCCTACTGGT
529601 ACTCGTTCTG CAAAATTGAA CTTATACAAA GTAAACCTAA TCCTACTTCC
529651 ACACCACACC ATTACCCTTC AAATAGTTAA AGAACAACAT GTAAACCTCA
529701 TAAATCTTCT TTGTTCAGCC TAAATTGTCT AAATCTTTTC AACCATTTCC
529751 ATCCGACATG ATGTCTAGAT ACGTCATCAT TCTGGCCACC TTCCTCTGGA
529801 GATCTAGAGT TTTTCTCTAA GTCTTTTCCA GAATTGAACC CAATACTCCA
529851 AATGTTTTCT AATCAATGTG AGAACACAGG GATAGCACGT TTCCTGCTGT
529901 GCCTCGATTA ATGCATCCTG AGTTTGCATT TGCTTTTTGA ACAGCTGCCA
529951 CGCGCTGTTG GCATAGGGAG AGCTTACTAC CAGCTTATCC CCAGCGGTCT
530001 TTCTCAGAGG AGTTTCTATT AAGCCAGGCC TATTTCTATA CTTGTCAATT
530051 GACTTTATTA CTTTTGAGTG CAATATTATA TTTTTATAGG TCTACACTAT
530101 ATATATATGT AAATCATATA TATAAATATG AACCATATAT ATCATATAAT
530151 TCATATATAA AAATATGAAT AGATATAGAT ATGTTGAAAA TGGTCTAGAT
530201 ATGTAATACC TATATAAATT TGTATAGATA GGTAAAGAAT GTATATTCTA
530251 GAAATATATA CTAGAATATA TGATATATTC TTTACATGTC TATACAAATT
530301 CTAGTATATA TAGAATATAT GATATGGAAT ATATGGTATA TGTACTTTAC
530351 ATCTCTATAC AAACATTATG TACTTTTCAT ATTCCCATTT CATAAATATT

FIGURE 3ZZZZZZ

530401 CCTATTCAAT TTCATTGTGT TTCTGTAAGT AAAATTTCTC AACCTGTCCA
530451 TGTCTTTTTC CATCTCAATT ACATCAGCTG GTACAATTAT TGTCCTTCTC
530501 AGTAACATCT GTGATTTGTT CTGCCTTGCA ATTTAGCTGT GTACTCTTAT
530551 CATAAGAGCT CAGCACTCCC TGTGCAGCAA TCATTTAGTA TACTCTCTAA
530601 TTTTCTTCTT CATTGGTACA ATTGTTTTTT CATTATTGGA ATTCTGTATT
530651 TTGTAGTTGC CTATCTCTCA CTCTTTATAG AATCTCTGAT CAAGAAATTG
530701 TACCCAATCC ATGTGCATTT TTTAACTGCC ACTCTGAAGT TTAATGTCTA
530751 CAGTTATGGC CGTACTTTTT CCCTGGACTG TAAATATCTT AAAGTGAAAA
530801 TGGTCAGTTT TTTCCCAGGT TTCCCCACCC CTTGCATTTC ATCAGTCTTT
530851 ATTCAGAACT AAATCAAAAT AACAGCTCTG TTGACTTTTT GAAAGACGGA
530901 CACAGCAGCG AGGCAGGCAA TTATGATTTT ATAGCTTCTC TCTTATTGCT
530951 TTCATGGTGG ACTAAATGAA TTCACAGCAT GGGAAAGTGT GTTTTGTGAG
531001 GATTGATTGA AGTGTGAAGC ACATGGACTT TCCATGTGGT CTAATGCAGT
531051 TCCTTGTTCA CATGGAAAGC TCTGATATTC TCTTCCTGCC AAAATCTTTG
531101 TCCGTGGTTT CCTCCTCGCT TCAGCCTATC AGGAAAAAAA AGTCTGTCTT
531151 TACCATTAAT AGTAGGCAAG AATTATTAAA TGTTCATCTG CTTGGGATGA
531201 GCTTTACATG CATTATTATT TCTTTTATCA TCACAAACCT ATAAATCACA
531251 AGGATCACAT ATGTCTATTT TACAGATACG AAAGCTAAGA TTTAAAGAGA
531301 TTAAGTTATT TGGTCAAAGT GAACCAGCTT GTAATAGTGA AGCCAGAGTA
531351 ATCTTATGTT ATAGCTCATG CTTTTATTAA CCACAACTTC ATTACAAATA
531401 ACCCTTTATA TTTATGAAGC CATACTTCTA TAAGAATATC TTCTTCTGGC
531451 ACTTGTACAA CTGATAATTC TGAAACCATC TTCACCTATC TTAGGTGAAT
531501 TTGGCTGTGT TCCTTGCTTT CATTCTGGCC ATCTGTCAGT CTTTCTGTCT
531551 GTAGTCACTT TCCAACTCTA TGACGTATAG ACTGTGTTTT AGCTGCTGAT
531601 TGAGTCTCTG TGATTTGTAG GCTGAAAGTG AATTACCATT ACCTAAGTGC
531651 ATTGATGCAC ACACACAAAA AAAAAACCAA CTGCCTCAGC AGAACCAACA
531701 GTAATGTGAA TATTGATTAT TGTCATGAAA TCATTATTTA GGATAGGATT
531751 ACAAATTTCC CTCATTTGTA GTGAGATTTG CATGTTCTGT GTGGCATGTC
531801 AATTTATCAT CATTCCCTGT CAGCTCTGCC TTCAAATATA TCCCAGGATC
531851 CAACCTCGTT TTACCACTTT GCAACAGCCT CCCTGGCCAA CCCACCAACA
531901 CCTCTCCTAG CCTCCCTTCT TCTACCACTC CGTGGTATGT TCTCCTAACA
531951 TGGAACCCTA GAATGGAAAG ATCCCTTGGA AATGTAAACC AGATTGTGTC
532001 CCTCTCTGCT CAAAACCTGC CAATCATGAT CTGTTCTGGT CAAAGTAAAA
532051 GCCTGGCCAC CTACTTAGCT GCCTCTTCAA TTGCATCTCC ACCAACCTTT
532101 CCTTCACGCA TTGCTCTGGC AACAATGGTG TCATTCTTCC TCAACTTTCT
532151 ACATGCACTC CTATCTCAAG ACCTTTGCAC CTGGTATTCT GTCTAACTAG
532201 GAAGCTCTTA GCTCCAGTAA CATCATGGCT CTGTCCCCAC TCCCTCACTT
532251 CCTCCAACTT CTATGACAAT GCAAATTTAT CAGAGACCTT TCAGGTCCTT
532301 CATAAACTAG CAATTCTCCT TTCTTACTCT CCTTCCCTCT CACCCTGCCT
532351 TTATTCCACA GTAATTATTA CCAACTAACA TGTACATGTG TTTTGTTTTT
532401 CCTATTGTCT GTCTTCCCTT TCTCTTTCTA ATTCACTGCT GTACCCTCAG
532451 CCCTTTAAAC ACTACTTGGC ATGTGGTAGG CACTATATAA ATTTTAATTA
532501 ATGGATATAG AATTTACAAG TGTTTATTTA TCTATTAAAT GACTTTATTC
532551 TCAAAAACCT AGTGTAGGGT TGAGGAGAAG GGAGCAGGAT CATAATTCTT
532601 CTTATGCATG TGCGGGGTTA ATTGCTGTGA TGGAATGCTG AAAAGAATGC
532651 ATCAGACTCT CAGAAAAAAA AAAGCAGGCA AGTCTAATTG AATTTTAGGA
532701 GAATTACATA GATTGCAATT AAAATGATCA CTATAATGTC AGTGTGGAGG
532751 AAGGATTTAG ATAAGCAGTG ATTGACAGCA GATAAACCCA TAAGAATTCA
532801 GGGATTCATG AGAACAAGGC AACAGAACAA GTCTCAGGTT TTTTACCAGA
532851 ATGACTGAGG TTAAAACAAA CAAACAAACA AAAAAACACA GGAATATTGG
532901 GATATTTGAC ATGTTGAGAT AATGTGGAAG AATCAAGTGT TTTCAAGCCA
532951 AGAATGAAAA TCTGGTCTAT GTTCTTGTTT GACGAAAATC ACTATGCTCT
533001 TGATGTATTA AATAACCCTT CTTTACCCCG TTATCTATAA TTCCTATGAA
533051 GACAAGGAAT GAACTTAGAT TATAACTGAT TGGTTGTAAC GTAGAGCTCT
533101 GCCTAGTGAG AAGCAAATCC AAGAGACACA ATTGTCCAGT TTCTAAATGT
533151 GCATAGCCAA AGAAAAGCCA AAAGAAAATA GCAAAAAAAA AAAAAAAAAA
533201 AATGGAGTCT GTCCCAAAGC AGGCAGGAAT GTCTTGCTTG CCAGAGTTGT
533251 ACGTCAAGTC CAGGAGGCTT TTTTCAGCTC GTTGTTGGGT CATGGGCCCA
533301 GTGAAATAAT GGGCCATTAC CTGACTAAGG AGAAAAAAAT AAAGGGGTAG
533351 GGAAGAGAGT TAAATTTTAT TTTTAAAACA GTAAATTTGA AAGTACAATT
533401 AGTGTGAATG TTGTCTTATA TTTGATGTAT TGGCCTGGTA AGGGTCACTT
533451 GTTGGTTGAT GGAACAAATG TTTATAGTAC TGGAGATCAG TGGTTCCTTT
533501 TTCCTTTACT CTATAACAGT GGTCCTCAAC CCCCAGGCTG TGGGCTTCAC
533551 CCACCTCCTG TCAGATCAGT GGTGACATTA GACTCTCATA GGAGAACAAA
533601 CCCTATTGTG AATGTGCATG TGAGGGACCT AGGTTGCGTG CTCCTTATGA
533651 GAATCTAATG CCTGATGATC TGAAATAGAA CAGATTCATC CTGAAGCTAT
533701 CCTCCCCCAA CCCTTCATCT GCGGAAAAAT TGTCTTCCAT GAAACCAGTT
533751 GCTCATGCCA AAAAGGTTGG GGACCTCCAC TCTATAAGAT CTAACTGCAC

FIGURE 3AAAAAAA

533801 TTTGCAAAAG CAATAATCAA AAGAATTGAA GGATGACAGA TTTCCATTAC
533851 GATTATAGAA ACTTTTAATT TATTTCTGTC TTTTTAAAAC TTTTAAGCTT
533901 TAAGTCAAAA TAATGTACAC ATATATCTTT AGAAAAGATA TACAAACTAG
533951 AAGGGCATAT AATGAAAAGC ACAAGGATGC CATGCCTTCT CTTTACTCCC
534001 CATCCAACCT CGATTCTTGT TCATCTGTGG CAATGATTTT TACCTGATTC
534051 TGTTTTTTAA TTATGAATTA AACGTTACTT ATTGACTTTC TGTTATCATG
534101 GATAAAGATA TAGCTTCCTT ACAGCACCCA CATCTCCTTT CCTCTCAATA
534151 TAATTGTTGC CTTTATAACT GATGATACCT TCATAACTTA AACATTAAGA
534201 TCTGTATATC TTCTTCCCAC AAATATAGTC ACTATGTTTT ATACTTTGGT
534251 AGTTTCTTAC CTATAATCAA GATACAAAAC ATACAAACAG CATATTTTCA
534301 AATTATTATA CAGTCTTGTG CCACTTAAGA ACAAGGATAT GCTCTGAGAA
534351 ATGCATTATT AGATTATTTC ATTGTGGTAC AAACATCATA GAGTGCACTT
534401 AACCCAAACC TAGATGGCAG CATCTATTGT ACGCTGAAGC TATATGGTAT
534451 AGCCTATTCC TTCTAGGCTA CAAAGCTGTA AAGCATACTG CACTGAATAC
534501 CTTAGGCAAT TGTAACACAA TGGCAAGTAT TTGTGTATCT AAACATAACA
534551 TCAAAAAGGT ATAGTAAAAA TGCAGCATAA AAATGTGGTA TAAAAGTGCC
534601 CTACCTGTGT AGGGCACTTA TCGTGAATGA AGCTTGAAGG ACTAGAAGTT
534651 GCTCTGGATA AGTCAGTGAG TGAGTAAGGT GTGAATGTGA AGGCCTAGTA
534701 CATTCCTGTA CACTACTGTA TGTAAACTTT ATAAACACTG TACACTTAGA
534751 CTACACTAAA TGTATAAAAT ACAAATATTT TTTCTTCAAT AATAAATTTT
534801 ATTTTATAAA CTTTTTAACT TTTTTAACTT CTTGACTATA ATAACACTCA
534851 GAATAAAGCA CGAACACATT GTACAGCTGT ATAAAAGATT ATCCTTATTT
534901 ATATTCTTAT TCTATAAGCT TTTTCCTGTG TAAATTTTGT TTTTAATTTT
534951 TAAATTGTTT TGTTACAAAC TAAAACACAA ACATACACAT GAGCTTAGGT
535001 CTACACAAGA TCAGGATCAC AAATATTGCT GTCTTCCACC TCCACATCTT
535051 TTGTCACACT GGAAGGTCTT TTGGGATGTG GTATGTGTAA GTTCATTCTG
535101 ACATTCCTAG AAATACCTGA GACTGGATAA TTTTATTTTT TTTTTAAAAA
535151 AAGAGGTTTA ATTGGGTTAA AATTCGACAG GTTGTACAGG AAGCACGATG
535201 CTGACACCTG CTCAGCTTCT GGGGAAGACT CAGGAAATAT ATAGTAATGG
535251 TGGAAGGTGA AGGGGGAGCA GGCATGTCAC ATGGCAGGAG AGGAGCAAAA
535301 TAGAGAGTGG AGGGGCAGGT GCTACATACT TGTAAACGAC CAGATCTCGC
535351 TATTATGAGA ACAGCACCAG GGGGATAGTG CTAAACCATT CATGAGAAAT
535401 CCACCCACAT AACCCAATCA TTTTCCATCA GGCCCGGCCT ACAACACTGG
535451 GGATTATAAT TCACCATGAG ATCTGGATGG AGAGACAGAT CCAAACCATA
535501 TCATGGTAGT AGATATTATG AAGAAGAGTG TGTTTGTCTC CTGCTAAGGT
535551 TCCAAAATGA CAGCTATCTT CTGGATATAC CTGAATTAAT TAATTCTATT
535601 ATTATCAATG GCTCATTTAA ACAAGCTTGA AACCCCTAGT ATCTTTTTTA
535651 GTTTCATAAT TAATCAGTTC AATAAGGAGT ATAGTTAAAT TAATTTCTGT
535701 AAAACCTTTA AAATGGTAGC TAATTCTTGG CTACTATTAT CTTCATATAA
535751 TAGGAAGCCA TAAGTAAAAG TATACAACAA ATAGCAATTT TTTTTCTAGT
535801 TCTAAAGTAC TATGCCCAAG CTCAAAGGGT TACCTACTCT TCGTAATATT
535851 TTCATAATTT TGAAACCAAC ACTTACTATT TGGGATAACA GTTCTGGACT
535901 TTAGTTTCCT GTACCTCTCA AAAATGAGGT ATATAAGAAC ATATTCAAAA
535951 AATGTAAAAT AAAACTTGAT GGTCACAGTA CAACCAGAAA TTGAGAAATC
536001 TGCCAATAAG GCAGAAGTTT TGATGTGCTT TCTTTAATAA CTTCTATTAC
536051 CCAAGGAATA AATTGAGTAA AGCTGGAGGA TCTGAATGAT ACAACTTAAA
536101 AAATTCTATC TGATGAATAT ATAGAGATTG AGTAAAGCTG GAAGATCTGA
536151 ATGATACAAT TTAAAAATTC TATCTTATGA ATATATAGAA ACAATAATAA
536201 ACTCAAATTT GCAGAATAAT ATTCCCTTTA AGCAGACAAA AAAATATAAT
536251 TGATCATGTT CCAGGTCATA AAGAAATTTG TAACAAATTT TAAAGGCTGA
536301 GATTTTTATA GAATACATTT CTAAACAAAA TTAAGTTAGA AATAAATAAT
536351 AGAACAGTAA CTTTAAAAAA CAGAGAATTT AAAATATTTT AAAATAACAC
536401 ATGAATTGTT TTCAAAGTAA TTAAATAACT CACTTAAATA ACTCATGGGT
536451 TATTTTTAATA TAATTTAGAA AATTTCTAGA CCTAAATAAT AGTGAAAAAA
536501 ACTACATCTT AAAACTTACA GGGCACAACT AATGTGATAC TTTAGAAGTA
536551 AATGTATCTA GCCTTAAAAT GCTTATTTTA GAAACAAAGA AATGATGAAT
536601 ATTAAAGAGC TAAGAATCCA GCTTAACAAT TTAGAAAAAG AGAAAGGGAA
536651 TAAAAGAAAG TAGAAGGAAA GAAATGGTAA AGATAAGATC AAAAACAGTA
536701 AATGGTGGTC AAGGGTGCAC AGGCTTATGC AAACCCACCC CCAAATTCTG
536751 AGAGAGATGA GAGGCTGAAG AAAGAGGCTG GCAAGTCCAG TTTCTCAGAA
536801 AGGAATATTT AATGGAGACT TACAAGTAGA GGCCATGTCT GTGCCTTCCA
536851 TGGAGACAAG ACAAGATGAT GGATCCTCAC GACATTACCC CCTATACCCA
536901 GGGCTTACGT ACCACAGAGA AAGAGTATTT GCGATTCAGA AGAGATATGT
536951 AGGACAATTG GAGCATGATA ACATTGAGGC TGTTTTGACC TAAGAGCAAG
537001 ATTTACAGTA ACTACCTGCT TTTTTTTTTT TTTTTTTTTT GACAGAATCT
537051 TGCTCTATCG CCCACGCTGG AGTGCAATGG TGCAATCTCG GCTCACTGCA
537101 ACCTCTGCCT CCTAGGTTCA AGTGTTTCTC CTGCCTCAGC CTCCCAAGTA
537151 GCTGGGACTA CAGGTGCACA CCATCACATC TGGTTAATTT TTGTATTTTT

FIGURE 3BBBBBBB

537201 AGTAGAGATG GGGTTTCACC ACGTTGGGCA GGCTGGTCTC AAACTCCTGA
537251 CCTCAGATGA TCCACCCACC TCGGCCTCCT AAAGTGCTGG GATTATACAT
537301 GTGAGCCACC GTGCCCGGGC AAGTACCTGC TCTTATACAA GAAACAATAA
537351 AACTGGAAAT TTTAGTGGCC TTCCCAGAAT ACACATTAAT CAAAAGTCAA
537401 TATGGGCTGG GTGTGGTGTC ACGCCTGTAA TCCTAGCACT TTGGGAGACC
537451 AAGATGGGAG GATCACGAGG TCAGGAGATC GAGACCATCC TGGCCAACAT
537501 GGTNNNNNNN NNNNNNNNNN NNNNNNNNNN NNNNNNNNNN NNNNNNNNNN
537551 NNNACCAAGA TGGGAGGATC ACGAGGTCAG GAGATCGAGA CCATCCTGGC
537601 CAACATGGTG AAACCCCGTC TCTACTAAAA TACAAAAAAA TTAGCTGGGC
537651 ATGGTGGCAT GCACCTGTAG TCCCAGCCAC TTGGGAGGCT GAGGGAGGGG
537701 AATCACTTGA ACCAGCGAGG TGGAGGTTGC AGTGAGCCGA GATTGTGTCA
537751 TTACGCTCCA GGCTGGTAAA AGAGCAAGAC TCTGTCTCAA AAAAAAAAAA
537801 AAAAAAAAAA AAAAAAAAGT CAACATAGTG GATTATTATG CAGGATGGAT
537851 TTGCTTTAGT CTTCACAAAT AGAAAACAAA ATAACAAGAA AACTAAAATT
537901 TGTTTCCTTA AAATACTAAT AAAATTTTCA AACTAACTCT GACAAAACAA
537951 ATCAAGAAAA ATATAAGGTA TAAGTGAACA ATATTACAGA TGAAAAAGGA
538001 AAAGAAGATA TAACTGCTGA TAAAAATATT TAAAAATCAA TAGGAAAATA
538051 CTATAAACAG CTTTGTTACA ATAAATGTAA AAATTAGATA AAAGAGACAA
538101 GTTTTTGGAA AATTATATAT TACAAAAACT GACCTCAGGA TAAATAGGAA
538151 ACTAAATTGT CCTATATTCA TTACATAAAT TGTGTCAGTG TTTTTCCCTG
538201 CAAAGGAAAT TTCAGATCCA GATTTTGAGT TTTTTTGAAA GTTTTACGGA
538251 ACACATAGTT CCAAAAAACA GATAAATCCA ATTTTACACA AATTCAAATA
538301 ATATTAAAAT TTTGCTCCCT AGGTAAAACT GTGAGCTGAA AAAGTTTGTT
538351 TGACTTACCA TTCTCCCTCC TAAAGCATAA ACTATTTACC TAATATTACC
538401 TAAGCCTCTT TTTCTGCTCA GTTAGGAACT AGTCCTTTCC TTCTACCCTG
538451 CACCAAAACA CAAAGCATGC ACCAAAGCTT GAAGTCACTT TGGAAAATAA
538501 CTGGTACTAA ACAGTCAGAA TGCTGTTATT GCTGGAAATC AACCTGTAAT
538551 GATGAGATTT CAGTGTGTCA TAGTAAACTG GAGACATATT TGGGAGATAT
538601 TTCACTTTCA CATTCAAACA CTGAGATAAG TCACTAATTT TGTCGCCATT
538651 CCCCTATATT AGAGTTTTAC AGTCTGATGG CATTAATGAC TGTCCAAATT
538701 CTCATTTTAT GTTAAGTATG AATTTTAAAA CATGTCCTTT TAGGAAATAC
538751 TTATTTAAAA ATTCAAAAGT TTCATTATGT TTACATATAT ATTTCTAAAT
538801 TTTATAAAAT TTTACTTCTT TAGTTATTAC TGCTTTTTTA TAACAATTGG
538851 AAGACTTAAA TTTGATAAGT AAAGGAAAAT TTCAACCTCC AGAATGCTGG
538901 GAAATGAAAA CTCTAAAACA ATTCTATGCT GTGGAGCATT TAGGGTTATT
538951 CTTTCAATTT CCAGGATTTT AAGTATTTTA TACAGTTGTT TCCAAAATGT
539001 GTTATTTACT TTTCATAAGC TATTAAAACA GTAGAAGATT AATCTTTTTC
539051 TAACATAGCA AAGAAAATTC ACAATAGCAA AAACTAGAAT GAAGAGATCT
539101 CACTTGCTGG CCAAATAATT AATACAATTG TTACAGTCTT GCCAATGCAC
539151 CACAATGTAG CAGTCTCTCA TTGTGAAGTG TCAGGCTGGA GTTCTTTATC
539201 TCAGGACCAA GAGAATTAAG GAGCCTGGAC ACAAAGGCTA AGGTTGGAGC
539251 AAAAGTTTTA ATAAGTGAGA GAAGAAAGAG CTCTGCAGTG GGTAGGGGGC
539301 CCGGAAGTGG AAGTGGTTGC CGTTTTTACA GTTGAATGCA AAGGCTTTTA
539351 TAAGAAAATG ATGAGGCCTA GCATCTCATT TGCATAAGGA GCAAATTTCT
539401 GTCAGCTCCA CCCCATCCTC CTAGTGTGCA TGTGGGCCCT TAGCTTGAGT
539451 TACTTTATAT AGCTTTGTTT CCCTTACTGT ATATGTGTCA GGGGACAGAG
539501 TTTTCCATTG CAGGCATGTC TGAGCAAGTC ACCTGTGTAG CCCTTCTTTA
539551 GCCAAGCCAC ACTGTGCAAG TTCTCTCATC TGTGCTTTCA GGCTGTTCTT
539601 TTGTTTGAAA GGATTCAACT GAGGACCCAC CTAAACTGCC TGCCCGATGG
539651 TATATTTTTC TTCCTCCTCT CTCACAATCT CATTTTGGTG TATATCCTTC
539701 TAATCTATTT CCTAAGCACA AAGTTTATTT TTTATTTTCA TAAAGTTGAA
539751 ATTATACCCT ATAGTATTTT TACGTATATA CTTAACATAC TTTTATATTC
539801 ACTTTCTAAT ATAACATGTA CATTTTCCAT GTTATTACAT GTAGTATAAG
539851 TTATCTGAAC AAATCTGTTT GTAAAAACTT GAAATCAATC CCAATTTTTT
539901 TATTATTTAT AAACCTGCTT TTTAAAAATA TTTTCTTTTT TTAATGCATA
539951 CATTATTTTA TTTGATCTGG TTACATGAGG TTACCTTTGT CATCCCCAGA
540001 ATTTTATAGA GGAAGTTCAA TTCAGTCTGA ATGGCAGTGT CCTCATAGGT
540051 GTGTCCACCA AGTAGAGTGG CAAGGGCGTA GACTTGCTAA ATCAGTGACT
540101 TTAGATAAGT TGTATAATCT CTTTGAAATT CAGGTTTCTC ATTTCTTTTG
540151 TTTTATTATT ATTATACTTT AAGTTCTGGG ATACATGTGC AGAACATGCA
540201 AGTTTGCTAC ATATGTATAC ATGTGCTGTG GTGGTTTGCT GCACCCATCA
540251 ACCCGTCATC TACATTAGGT ATTTCTTCTA ATGCTATCCC TCCCCTAGCC
540301 CCCCACCCCC GACAGGCCCT GATGTGTGAT GTTTGCCTCC CTGTGTCCTT
540351 GTGATCTCAT TGTTCAACTC CCACTTATGA GTGAGAACAT GTGGTGTTTG
540401 GTTGTCTGTT CCTGTGTTAG TTTGCTGAGA ATGATGGTTT CCAGCTTCAT
540451 CCATGTCCCT GCAAAGGACA TGAACTCATC CTTTTTTATG GATGCATAGT
540501 ATTTCATGGT GTATATGTGC CATGTTTTCT TTATCCAGTC TGTCATTGAT
540551 GGGCATTTGG GTTGGTTCTA AGTCTTTGCT ATTGTGAACA GTGCTGCAAT

FIGURE 3CCCCCCC

540601 AAACATATGT GTGCAGGTGT CTTTATAGTA GAATGATTTA TAGTCCGTTG
540651 GGCATATACC CAGTAATGGG ATTGCTGGGT CAAATGGTAT TTCTGGTTCT
540701 AGATCCTTGA GGAATCACCA CACTGTCTTC CACAATGGTT GAACTAATTT
540751 ACACCATCAA CAGTGTAAAA GTGTTCCTAT TTCTCCACAT CCTCTCCAGC
540801 ATCTGTTGTT TCCTGACTTT TTAATGATCG CCATTCTAAC TGGCATGAGA
540851 TAATATTTCA TTGTGGTTTT GATTTGCATT TCTCTGATGG CCAGTGGTGA
540901 TGAACTTTTT TTCATGTGTT TGTTTGGCCA CATAAATGTC TTCTTTTGAG
540951 AAGTGTCTGT TCATATCCTT TGCCCACGTT TTGATGGGGT TGTTTTTTTC
541001 TCGTAAATTT GTTTAAGTTC TTTGTAGATT CTGGATATTA GCTCTTTGTC
541051 AGATGGATAG ATTGCAAAAA TTTTCTCCCA TTCCATAGGT TGCCTGTTCA
541101 CTCTGATGAT AGTTTCTTTG CTGTGCACAC ACTCTTTAGT TTAATTAGAT
541151 CCCATTTGTC TATTTTGGCT TTTGTTGCCA TTGCTTTTGG TGTTTTCGTC
541201 ATGAAGTCTT TGTGCATGCC CACGTCCTGA ATGGTATTGC CTAGGTTTTC
541251 TTCTAGAGTT TTTATGGTTT TAGGTCTTAC ATTTAAGTCT TTAGTCCATC
541301 TTGAGTTAAT TTTTGTATAA AGTGTAAGGA AGGGGTCCAG TTTCAGTTTT
541351 CTGCATATGG CTAGCCAGTT TTCCCAACAC CATTTATTAA ATAGGAAATC
541401 CTTTCCCCAT TGCTTGTTTT TGTAAGGCTT GTCAAAGAAC AGATGGCTGA
541451 GATTGGTGGA GTTAGTTCTG AGACCTCTGT TCTCTTCAGT TGGTCTATAT
541501 ATCTGTTTTG GTACCAGTAC CATGCTGTTT TGGTTACTGT AGCCTTGTAG
541551 TATAGTTTGA AGTCAGGTAG CATGATGCCT ACCAGCTTTG TTCTTTTTGG
541601 TTAGGATTGT CTTGGCTCTA CAGGCTCTTT TTTAATTCCA CGTAGTTGTT
541651 TCTAATTCTG TGAAGAAGTC AATGGTAGAT TGATGGGGAT AACATGGAAT
541701 CTATAAATTA CTTTGGGCAG TATGGCCATT TTCACGATAT TGATTCTTCC
541751 TATTCATGAG CATGGAATGT TTTTCCATTT GTTTGTGTCC TCTCTTATTT
541801 CCTTGATCAG TGGTTTGTAG TTCTCCTTGA AGAAGTCCTT CACATCCCCT
541851 GTAAGTTGTA TTCCTAGGTA TTTTATTCCC TTTGTAGTCA TGCGAGGGGA
541901 AGTTCACTCA TGATTTTTCT CTCTGTCTAT TATTGGTGTA GAGGAATGCT
541951 TGTGATTTTT GCACATTGAT TTTGTATCCT GGGACTTTGC TGAAGTTGCT
542001 TATCATCTTA AGGAGATTTT GAGCTGAGAT GATGGGGTTT TCTAAATATA
542051 CAATCATGTC ATCTGCAAAC AGAGACAGTT TGACTTCCTC TCTTCCTATT
542101 GAATACCCTT TATTTTTTCT CTTGCCTGAA TGACCTGGCC AGAACTTCCA
542151 ATACTTTGTT GAATAGGAGT GGTGAGAGAG GGCATACTTG TCCTTGTACC
542201 AATTATCAAT GGGAGTGCTT CCAGCTTTTG CCCATTCACT ATGATATTGG
542251 CTGTGGGTTT GTCATAAATA GCTCTTATTA TTTTGAGATA TGTTCCATCA
542301 ATACCTAGTT TATTCAGAGT TTTTAGCATG AAGGAGTGTC GAATTTTATC
542351 GAAGGCCTTT TCTGCATCTA TTAAGATATT CTTGTGGTTT TTGTCATTGG
542401 TTTTGTTTAT GTGATGGATT ATATTTTTTG ATTTGCATAT ATTAAACCAG
542451 CCTTGCATCC CAGGGGTGAA GCTGACTTAA TCGTGGTGGA TAAGCTTTTT
542501 GATATGCTGG CAGATCGTTT TGCCAGTATT TTATTGAGGA TTTTTGCATT
542551 GATGTTCATC AGGGATATTG GTCTGAAATT TTCTTTTTTT GTTGTGTCTG
542601 CCTGGTTTGG GTATCAGGAT GATGCTGGCC TCTTAAAATG ACTTAGGGAG
542651 GAGTCCCTCT TTTTTCTGTT GTTTGGAACA GCTTTAGAAG GAATGGTACC
542701 AGCTCCTCTT TGTACCTCTG GTAGAATTTG GCTGTGAATC TGTCTGGTCC
542751 TGGGCTTTTT TTTTGATAGG CTATTAATTA CTGCCTGAAT TTCAGAACTT
542801 GTTATTGATC TATTCAGGGA TTCGACTTCT TCCTGGTTTA GCCTTGGGAG
542851 GGTGTACGTG TCCAGGAATT TATCCATTTC TTCTAGGTTT TCTAGTTTAT
542901 TGGTGTAGAG GCATTTATAG TATTCTCTGA TGGTAGTTTG TATTCTGTGG
542951 GCTCAGTGGT GATATCTACT TTATCATTTT TTGGGTGTGT CTATTTGATT
543001 CTTTTCTCTT TTCTTCTTTA TTAGTCTGGC TAGCAGTCTA TCTATTTTGT
543051 TAATCATTTC AAAAAACTGT CCCCTGGATT CATTGATTTT TTTTTGAAGT
543101 ATTTTTTGTG TCTCTATCTC CTTCACTTCT GCTCTGATCT TAGTTATTTC
543151 TTGTCTTCTG CTAGCTTTTG AATTTGTTTG CTCTTGCTTC TCTAGTTCTT
543201 TTAATTGTGA TGTTAGGGTG TCAGTTTAGA TTTTTCCTGC TGTCTCCTGT
543251 GGGCATTTAG TGCTATAAAT TCCCCTCTAA ACACTGCTTT AGCTGTGTAC
543301 TAGAGATTCT GGTACATTGT GTCTTTGTTC TAATTTGTTT CAAAGAACTT
543351 ATTTATTTCT GCCTTAATTC ATTATTTACC CAGTAGTCAT CCAGGAGCAG
543401 GTTGTTGAGT TTCCATGTAG TTGTGCAGTT TTGCGTGAGT TTCTTAATCC
543451 TGAGTTCTAA TTTGATTGCA CTGTGGTCTG AGAGACTGTT ATAATTTCCA
543501 TTTTTTGCAT TTGCTGAGGA GTGTTTTACT TCCAATTATG TGGTCAATTT
543551 TAGAGTAAGT GCGATGTGGT GCTGAGAAGA ATGTATATTC TGTTGATTTG
543601 GGGTGGAGAG TTCTATAGAT GTCTATTAGG TCCACTTGGT CCAGAGCTGA
543651 GTTCAAGTCC TGAATATCCT TGTTAATTTT CTGTCTAATT GATTTGTCTA
543701 ACATTGACAG TGGGGTGTTA AATCTCCCTC TATTATTGTG TGGGAGTCTA
543751 AGTCTCTTCG TAGGTCTCTA AGAACTTGGT TTATGAACCT GGGAGCTTCT
543801 GTATTAGGTG CATATATATT TAGGATAGTT AGCTCTTCTT ATTGCATTGA
543851 TCCCTTTATC ATTATTTAAT GCCCTGCTTT GTCTTTTTTG ATTTTTGTTG
543901 CTTTAAAGTC TGTTTTATCA GAGACTAGGA TTGCATCCCT GGCTTTTTTT
543951 TTTTNNNNNN NNNNNNNNNN NNNNNNNNNN NNNNNNNNNN NNNNNNNNNN

FIGURE 3DDDDDDD

544001 NNNNNNNNNN NNNNNNNNNN NNNNNNNNNN NNNNNNNNNN NNNNNNNNNN
544051 NNNNNNNNNN NNNNNNNNNN NNNNNNNNNN NNNNNNNNNN NNNNNNNNNN
544101 NNNNNNNNNN NNNNNNNNNN NNNNNNNNNN NNNNNNNNNN NNNNNNNNNN
544151 NNNNNNNNNN NNNNNNNNNN NNNNNNNNNN NNNNNNNNNN NNNNNNNNNN
544201 NNNNNNNNNN NNNNNNNNNN NNNNNNNNNN NNNNNNNNNN NNNNNNNNNN
544251 NNNNNNNNNN NNNNNNNNNN NNNNNNNNNN NNNNNNNNNN NNNNNNNNNN
544301 NNNNNNNNNN NNNNNNNNNN NNNNNNNNNN NNNNNNNNNN NNNNNNNNNN
544351 NNNNNNNNNN NNNNNNNNNN NNNNNNNNNN NNNNNNNNNN NNNNNNNNNN
544401 NNNNNNNNNN NNNNNNNNNN NNNNNNNNNN NNNNNNNNNN NNNNNNNNNN
544451 NNNNNNNNNN NNNNNNNNNN NNNNNNNNNN NNNNNNNNNN NNNNNNNNNN
544501 NNNNNNNNNN NNNNNNNNNN NNNNNNNNNN NNNNNNNNNN NNNNNNNNNN
544551 NNNNNNNNNN NNNNNNNNNN NNNNNNNNNN NNNNNNNNNN NNNNNNNNNN
544601 NNNNNNNNNN NNNNNNNNNN NNNNNNNNNN NNNNNNNNNN NNNNNNNNNN
544651 NNNNNNNNNN NNNNNNNNNN NNNNNNNNNN NNNNNNNNNN NNNNNNNNNN
544701 NNNNNNNNNN NNNNNNNNNN NNNNNNNNNN NNNNNNNNNN NNNNNNNNNN
544751 NNNNNNNNNN NNNNNNNNNN NNNNNNNTTT CAGCTCCATC AGGTCATTTA
544801 TGTTCTTCTC TAAACTGATT ATTCTAGTTA GCAATTCCTC TAACCTTTTC
544851 TCAAGGTTCT TAGCTTCTTT ACATTGGGTT AGAACATGCT CCTTTAGCTC
544901 AGAGGAGTTT GTTATTACCC ACCTTCTGAA GCCTGCTTCT GCCTATTTGT
544951 CAAACTTATT CTGCATCCAG TTTTGTTCCC TTGCTTGTGA GGAGCTGTGA
545001 TCCTTTGGAG GAGAATTCTC ACTCTAGTTT TTGGAATTTT CAGCCTTTTT
545051 GTGCTGGTTT TTCCTCATCA TGGATTTATC TACCTTTGGT CTTTGATGTT
545101 GGTGACCTTA GGATGGGGTT TCTGTGTGGA CATCCTTTTT GTTGGTGTTG
545151 ATGCTACTCC TTTCTGTTTG TTAGTTTTCC TTCTAGCAGT CAGGCCCCTC
545201 TGCTGCAGGT CTGCTGGGGT TTGCTGGAGG TCCACTCAGA CCCTGTTTGC
545251 CTGAGTATCA CCAGCGGAGG CTGCAGAACA GCAAATATTG CTGCCTCTTC
545301 CTTCCTCTGG AAGCTTCATC CCAGAGGGGC ACCCACCAGA TGCCAGTGGA
545351 GCTCTGTTAT ATGGGGTGTC TGTTGACACC TCCTGGGAGG TGTATCCCAG
545401 TCAGGAGGTA CAGGAGTCAG GGATCCACTT CAGGAGGCAG TCTGTCCCTT
545451 AGCAAAGCTT GAGCTCTGTG TTAGGAGATC CACTGCTCTC TTCAGAGCCA
545501 GCAGGCAGGG ATGTTTAAGT CTGCTGAAGC TGCACCCATA GCTGCCCCTT
545551 CTCCCAGGTG CTCTGTCCCA GGGAGATAGG GACTTTTATC TATAAGCCCC
545601 TGACTGGGAC TGCTTCCTTT CTTTCAGAGA TGCCCTGCCC AGAGAAGAGG
545651 AATCTTGAGA GGCAGTCTGG CTACAGCAGC TTTGCGGAGT TGTGGTGGGC
545701 TCCGCCCAGT TTACACTTCC CAGCAGCTTT GTTTACACTG TGAGGGTAAA
545751 ACTGCCTACT CAAGCCTTAG TAATGGTGGA AGCCCCTCCC CCCCACCAAG
545801 CTGGAGCATC AGACTGCTGT CCTGGCAGCA AGAATTTCAA GCCGGTGGAT
545851 CTTAGCTTTC TGGGCTCTTT GCGGGTGGGA TCCACTAAGC TAGACCACTT
545901 GGCTCCATGG CTTCAGCCCC CTTTCCAGGG GAGTGAATGG TTCTGTGTCA
545951 CTGGCATTCC AGGTGCCACT GGGGTATGAA AAAAAAAAAA CTTCTGCAGC
546001 TAGCTCGGTG TCTGCCCAGA CAGCTGCCCA GTTTTGTGCT TGAAATCCAG
546051 GGCTCTGGTG GTGTATGCAC CCAAGGGAAT CTCCTGTTCT GCGGGTTGTG
546101 AAGACTGTGG GAAAAGTGTA GTGTCTGGGA TGCAATGCAC TGTTCCTCAC
546151 ATCACAGTCC TTCACAGCTT CTCTTGGCTA GAGGAGGGGG TTCCTCGACC
546201 CCTTGCACTT CCCTAGTGAG GCAACACCCC ACCCTGCTTC GGCTCACCCT
546251 CCATGGGCTG TACCCACTGT CTAACCAGTC CCAATTAGAT GAGTCGGGTA
546301 CCTCAGTTGG AAATGCAGAA ATCACCCACC TTCTATGTTG ATCTCGCTGG
546351 GAGCTGCAGA CCGGAGCTGT TCCTATTAGG CCATCTTGCT AGCCCTATAA
546401 CCTGCTTTTA GCATTGAATG CCATATGAGT CATTATGGTA TAACATTTTT
546451 ACAACTTAAA ATTTGTTAAA ATTTTAATCA GTTATAGTAA TGAACAATAA
546501 GCACTTTCAT TGTTCTTATT GAAACAAAAC CAAAAGAAGT GAAGAAATGA
546551 TTGTGTTCAA TGATATATCC AACCTAACAA AAATGCCCAG CACATATTTC
546601 ATTAGTCCTA ACATATTTTT TTTTCATTTA ACATCATTGA ATTTGGATTG
546651 CTTCTTATAA TTGCCAGCAT TTTTAGTTTA ATTTGTGGAA TTATTTCCTT
546701 CCTAGAAGGA TATATAATAA TAGTTCAAGA TATACATCGC AATCTAGGAC
546751 TAGGTGAAAC ACAATATTCT TAATAAATAA AATAATGAAG CATAAACTTT
546801 TTTTAAGTAT GATGAATATC TTGTGACAAA CAAACTGAGA TTTTACCTAA
546851 AATAATAAGG TTTACATTAG TGACAACGGA GCTTTAACAT CAAAACAAAC
546901 TTTTTCATAT TTATTTTTCT AGTAGGACAT CTGCCTGTTA TGGTCCTTGG
546951 AGAATAAATA AGATCACATT AAAATGTCAA CAATTCTCAA TCATGGTTTA
547001 ATTTACAGAG GTATTAGTAA TTATCTATGA GTATTTTTCA TTTAAGATAA
547051 AATGATCTAA TAATATAGTT TTATTTGTAA ACTTTCAGTA TATTAAAACT
547101 ATGCAAAGTA TTTGTTGCTG TTAAGGACTA GCATAGTATC ATTTTATAAT
547151 AAATAGTAAT TCAGGACACT TTTTTAAAAT CAAAATAATT ATTTGAATAT
547201 TTTTGGAAAG ATGCCTTTTC TCTTATTTTT TTAAAGCATT TTGAACAGTA
547251 CATCTGACAG TCCACTAGCT CCTCTTAGAC GTGGCTATCT AAACACAAGC
547301 CCTCCAATGA AAATACTGAT TATTATTATT GTTTTGAGGC AGAGTCTCAT
547351 TCTGTCACCC AGGCTAGAAT GCAGTGGCAC TATCTCAGCT CACTGCAACC

FIGURE 3EEEEEEE

547401 TGTGCCTCCG GGTTCAAGCG AGTCTCCTGT CTCAATCTCC GGAGTAGCTG
547451 GGATTACAGT CATTGCACCA CCACACCCGG CTAATTTTTG TATTTTTAGT
547501 AGAGAAGGGG TTTCACCATG TAGGCCAGGC TGGTCTCAAA CTCCTGACTT
547551 CCGGTGATCT GCCCACCTCG GCCTCCGAAA GTGCTGGGGT TACAGATGTG
547601 AGCTGCCGCG TCTGGCCCAA TACTGATTGT TTTTATTTCC TGACTAAATT
547651 CCAAAATGTC TTTTTTTTGC TAGTGCAGAC ATTCTCCCAT ACTGGGGTAA
547701 ATGATATTCT CCCATGGTTG CCTTCTCAAT TAACTATTGA AAATGTTTAG
547751 TGTGTACTTT CACATAGAGA GTTAAATACC GATGCAGGTG TCTATCATGA
547801 GGACATATTT CCAATCAATC CATATTTTAC TAATGTTACA TATTTTCATT
547851 AAGTAACATT ATTTACTCAT GGTGTTCAAT ATTGTGAACA CTAGGGAATT
547901 AAAAAGAAGA CAAAATCCTT GTCCTCAAAA ATTTCACAGT GTATGTTGGT
547951 AGGAATGTAA ATCAGTGCAG CCATGGTAGA CAACAGTGTG GAAGTTCCTC
548001 AAAAAATGAA AAATAGCACT ACCATATGAT CCATCAATCC CACCACTGGG
548051 TATATATCCA AAGGAAATGA ATTCAGTATG TCAAAGAGAT ATCTGCACTG
548101 CTCATGTTTA TTACAGCACC ATTCACAATA GTTTATTCAC TATTCACAAC
548151 AACCAAGATA TTGAATCAAC CTAAGTGTCC ACCAACAGAT AAATGGATTT
548201 TTTAAAATGT GATGTGGTAT ATGTACCCAA TAGAATACTA TTCAGCCATA
548251 GAAAGAAGGA AATCCTGTCA TTTGTGACAA GATTGATGAA TCTAGAGGAC
548301 ACTATGTTAA GTGAAATAAG CCAAGCACAG AAGGACACAT ACCACATGAT
548351 CTCACTCATA TGTAGAATTA AAAAAGTTGA TCTCTTAGAA ATAGAGCATA
548401 GAATAGTGGT TACTAGAGAC TGGGGAGAGT GGGGGTGGGA GTGGGGTAGG
548451 GGGTGAGGGT TGGTCAATGG GTACAATGTT ACAGTTACAC AGGAGGAATA
548501 AGTTGAGAAT GGTGCATATG TCAATTACCC TGACTTGATC ACTACACTAT
548551 ATATATATAT AAACATCACA CTATGCCCCA TAAATTTGTA CAATTATTAT
548601 GTAGCAATTA GATAAAAAAG CTTTAAATTT CACAATGCAC TGAGAGAGAA
548651 AAATGAACAG AAAATTACAG CTAAGAGAAT GCCGTTAACA GAAGAATGCA
548701 AAAGAGAGCT TCAGAGGGTG TTGAGAAATT GTGCTTAAAA GAATGATATA
548751 ATTCAGCCTA AATGGAAACT AATATTGAGA ATTTACTCTG CACCAAGACC
548801 TATGCCATCC ATGAATTACC ACAAGTTAGT GGCCTTAAAA AACACACAGT
548851 TTATTATTTT GCATTTCTCA AAGTCAGAAA TCCAAAATCA GATTCACTGG
548901 CTAAAATCAG GGTGTTGGCA GAACTGATAT CTTCCAAAGT TCTCAGGCAA
548951 GAATCTGTTT CCTCCTCTTT TCCAGCCTCT AAAGATGGCC TTCATTCCTT
549001 GGCTCATGGC CCTTCTCTGT CTTTGAAGTC ATCAGTATAG TATCTTCAAA
549051 TTTCCCTCTG ACTCTCTTAC CTCTATTTTC CTCCTCCCAC CTCCTTCTCT
549101 GTGTTTCTTG CCTCCCTTTC ATATGTACCC TTGTGAGTAC GCTGAACCTA
549151 CTTGGATAAT TAATGATAAT CTTCATATTT CAGGATTATT AATACATCTG
549201 TAAAGTCTTT TTTGCTAAAC ATGGTAACAT ATTCACAGAT TTAGTGGATT
549251 ACAATGTAGT CATCTTAGGG GAAGCCATTA TCCAACCAAC CACAGCTCCA
549301 TAATGAATTA AGGGATAAAG AAGGAAAAAT GGGTTTTAGG AGATTCTCTG
549351 GACTGAATTG TGTCCCCCCA GAATTCATAT TTTGAAGCTC TAACTTATAG
549401 TATGACTATG TTTGGAGATA GGATTTTGAG GAAGTAATTA AAGTTAACTG
549451 AGATCCTAAG GGTATGGTCC TAATCTGGTG ATAGGATTGT TAGCCTCATA
549501 GAAGAGAAAG AGAGAGATCC CTCTCTCTCC ACACTCATGC ACCTAGGAAA
549551 GACCATGTGA GGACACAGTG AGAAGGCAGC TGCCTACCAG CCGGGAAGAG
549601 AGCTCTTATC AGGAGCCGAA CTGGCCAGCA CCTCCATCTA GCACTTCCCA
549651 ATCATCGGAA CCTTGAGAAA ATAAATGTCT GTTGTTTAAA CCACCTAGTC
549701 TGTTGTATTT TGTTATGGCA GCCTGAGCAG ACTAATACAG CAGATGACAA
549751 TGAGATGGTC CTTACAAGAC TTCCAGGATT CAAGGAAGAA GTCTGAGCTA
549801 CAAATGTAGA TTTGGGATAT CACAGCCTAA AGACGATAGT TGGTGGTGAT
549851 GAAAGACATT AACCTGAGAT AGTATGTAGA TTGAAAATAG AATATAGCTG
549901 AGAACAGAAC CATACATTAC TAATAACACT ACTATCCAAT TCTCCAAATG
549951 TGCTCAGTAG CCTGATTGTG GGAGGAATGA CTAGCAGATG GTTGAATTTG
550001 TTTTAGGTTT CAATTGCAGG GTGTGTGTGG CCAAAGGGCA AGTGAAAGTG
550051 GGTGGTAGCA ATAACATAAG CTGCCAGAGA CAGTGCTGGG TGTTTTATGT
550101 GCCTTTACTT CCTATCATTC TGTTAATCAG ATAGTCATAT TTTATAGATA
550151 AAGGAAACTG AGATTCGAAG ACATTGAGTA AGTTTCCCAG GGTCACAAAA
550201 ATTTTTTTTA TTACATTTGA TTTCTAACAG GATTCTTCTG ATGGAAGAAA
550251 TGGAAAATCA ATTTCAATAG TGCATTAAGC AGAGCTAGTT TTGAATTGCA
550301 AATGTTTTTT ACTCTAAAGT GAAGCTCTTT CAATGTACCT CAAGGGAAGA
550351 AATCAGGTAG TATGAGAGGC CATCTGGTAG AGACTGATAC ACTAGGTCAC
550401 AAAAACATTC TAGGGGTAGA TGTATCAGTG AGTTTGAAAA GTTGAAACTA
550451 TGAATAACAG TATTCAGTAA GTGAGTAATG TACTGGACTT CATGATTTCA
550501 GGTGAAGAGA AAAATTTAAT CTCCTTGAGG ACAGTGCTAT ATTTAGAGGC
550551 ATGCTTTAGT GGAAAAGAAT AAAAACTTGT TCAAAAGGAA AAATAAGCTA
550601 TCTAATGTTT GAAATATGTG TGATTTGAAA AAAAATGATG TTTTTTTCTT
550651 AACTCACTCA CTGAAGAAAT CCTTAACCAC TGTATGATAA GAAAGTTAAA
550701 AAAAAAAAAA CACCTCATTC TCAGGTCTTA AAGAAATCCT GCTTCCTGGC
550751 CTAGACCTTA CGGACCTAGC AATGAAGGAT ATTCAGAGTG GCATATTTAA

FIGURE 3FFFFFFF

550801 CATGTTCTCT ATGGTATCGG TATAATTTTA AAAGACTTAG TGGTTACAAG
550851 GAACTTTTCT AAGACTCACA TAGCTTTACA AATATTTACA CATTAATCTG
550901 TATCTCTCAA GAAGTAGATA GGTGGTAGGT ATTTAACCAA CTAACAATGA
550951 TACTAAAGCA AGAAAAAGTA AAGCGACTTC CTCTAATGCC ACAAAACAGT
551001 TAGGGGTGAC ACCAGAAATG GAAGCCCTAA CTTCTAAGAT CGTGTCCTGA
551051 CAAATGCGTT GGTCTACTCC TCCTACTAAC AAGCCTTGTT AAGCATGAGA
551101 AATCTTGCAT AATATTGAAC CTCTCTGTGA AGTTGAATCA GAAGCATTAA
551151 AATATCAATT CAGCTGATGT TTGAAACTTG TAAGTTTTCT TTAAAATGTT
551201 CACTTTCATA TGTAGAAGGT ATGCTATATA TCAGGAAGAA ATCAGACAGA
551251 ATTCATCATG AGAATACTGG CATTTCATCC TTGAATGACA AGCACTGAAT
551301 ACAGTCAGAT GGGTGACTAT CCAGATAACA TTAATAATAA CGGAATTTAC
551351 TTTAAGACTT CAAGAGACGA ATACACATCC GTCTAGAACT GAATTAAAAA
551401 TCTAATGTTG TATGTTTTTT TCTCTATGTC TCTTCTTTTA TAACTCCTTT
551451 ATATGACATT TTAAAATATT TTTTCTGTTG CCTTTACACA ATAGGAAAAT
551501 GGATTTTATG CAGTTAAATT AAATAAAAAA GATGAAACTG AAGACAGGAA
551551 TGCAAAAGAT ACTATGCAAA TTTTAAAAAT GTTAACATAT TGGAAAATTT
551601 CTTGACTTCT ACATCTACCC TAGAATATCC CAGCTTTGGG TCTAGGTTGT
551651 TTTCCCCCCT CATTCATTTA TTTCATTCAT GCAACAAATA TTAAAAAGAT
551701 ATTTATTATG TACTAGGTGC TGTGGAAACA ACAGAAAATA AAGACATTCA
551751 AGGCAGAACA AACCATGTCT TCATGGTTAG ATGGTCTTCT TGGTTAATCA
551801 TGTCTTCATG ACTTAGATTA TAGGAGACAT GATGGGATCG GCGGAAGTGT
551851 TGAAATGTGA AGACAGTTAA TAAATAAATA GACAAGTTCA AAATGATATT
551901 CAAAAGTAAT TTCAAATAAC CAAAAAGTGT TGTGTAGTAA GTATATTAAT
551951 ACTCTCAAGC CAGAGTCCAC TAGGAACACA CTACAGTTGA ACAAATTGGG
552001 TTTATCACTT ATTGAAGCAG GAGAAAATAC ACACCAGGAA GAACTATAGT
552051 GTGTGTCAGT AAGAGGGTGT TAGAAAGAAC CAATTATAGA ATTTGGGCTT
552101 TTGATGGGTA ATTTGGGAGA GGGACCAAAG AAGCAGGGGT TTGCTCTAGA
552151 TTGAATGCTA TCAGAAAGTA AAGGCAATTC TATGATTAGA CGTCTGGGTT
552201 TTTTTTTCTT TTTCATAAAT GTTATTTTTA ATTAACAATA ATTTTATATA
552251 TTAATGGGAT GCAGTGTGAT GTAATAGATG TGCATATTGT AGAATAACTA
552301 AATCAAGCTA ATTAAAAAAT TTGTTACTTC ACATGCTTAT TTTTGTGGTG
552351 AAAACATTTA AAATCTACTC TCTCAGCAAT TAAAAAATAT ACAATGATAT
552401 TATTTATTAC AGTTACCATT CTGGGCAATA AGATCATTAA AGCTTATTTC
552451 TACTGTCTAA CTGAAATTTT ATATACTTTG ATCAACACCT TCCCTTTCCC
552501 CACCGGTGCC CCCACCCCAC ACTGAATCTG GTAACCACCA TTCTCCTCCC
552551 TTCTTCTATT AGTTCAATAT TTTTAAATTC CACATCGGAG ATCATGTGCT
552601 ATTTGTCTTA CTGTTTCTGG CTTATTTCAC TTTCCATAAT GTCCTCCATT
552651 CCATCCCTGT TGCACAAGTA ACAGAATTTC CTTTTTCTTA AGGAGAATAG
552701 TACTCCAATG TGTGTATATA CACCAGGTTT TATTGATCCA TTCATCCAAT
552751 AATAGACACC TATGTTGCTT CCATATCTTG GCTATTGTGA ATAATGCTAC
552801 AGTGAACATT GGAGTGCAGA TAGCTCATCA GCATATTGAT TTCTCTTTCT
552851 TTGGGTATAT ACCCAGAAGT GGGATTGATG GATCATATAG TAATTCTATT
552901 TATCTTGAGG AACCTCCATA TCATTTTCCA TAATTGCTGT ATTCGTGTAC
552951 ATTCCTGCCA ACAGTGCACA AGGTTTTCCC TTTCTGCACG CTCTCATGAA
553001 CATTTGTTAT CTTTTGTGTT TTTGACAATG GCCATTATAT CAGGTAACAT
553051 CTCCGTGTGG TTTTAAATTG CATTTTCCTG ATAATTAGTT ATAGTGAGCA
553101 TTTTTTATTC ATATATCTAC TGCCATTTGT ATGTCTTCTT TTGAGAAGTG
553151 CCTATTGTAA ATAGTGCTGC AATAAACATG GCGGTTCAGG TATCTTTAGA
553201 CATACTGATT TTTTTTTTTC CTTTGGATAA ATATCCAGCA GTGTGATTGC
553251 TGGATCATGT GGTCGTTCTT TTGTTTGTTT GCCTTTTTTT TTCTTTTTGA
553301 GAGATCCTCC ATACTGTTTT CCATAGTGGC TATACTAATT TATATTCCCA
553351 TCAACAGTGT ATAAGTGTAA CCGTTTTTCT GCATCCTCAC CAACACCTAT
553401 TATTTTTGTA TTTATAATAA AAACCATTCT AACAGAAGTA AGATGATATC
553451 TCTTTGGGGG TTCTAATTTG CATTTTCCTG ATAATTAGTG ACATTGAGCA
553501 ATTTTTCTGA TAGCTGTTGG CCATTTTTAT GTCTTCTTTG CAAAATGTAT
553551 ATGCATATCC TTTGCCCACT TTTTAATAAA ATTATTTGTT TTTTTGTTTG
553601 TTTTGTTTTG TTTTTTGGGT TGTTTGAGTT CCTTGTATAT TCTGGCTATA
553651 GGTCCCATGT CAAGTAAATA ATTTTCAGAT ATTTTCTCCC ATTCAACAGG
553701 TTTTCTCTTC ACTCTGTTGA TTGTTTCCTT TGCTGTGCAG AGCTTTTTAT
553751 TTTAAATAGT ACCATTTGTC TACTTTTCTT TTTGATGCCT GTGCGTTTAA
553801 GTACTAAGCC ATACAAACTT TGCATAGCCC GGGATCCTGA AGTGTGTTCC
553851 CTATGTTTTC TTCTATTAGC TTTATGGCTT TGGGTCCTGC ATTTAAATCT
553901 TTAATATCTC TAGAGTTGAC TTTTGTATAT GGTGAGAGAT AGGGGTCCAA
553951 TTTCTTTCTT CTGCATATGG ATGTCCGATT TTTACAGCCT TGTTTATTGA
554001 AGAGGATATC TTTTCCCCAA TGTATGCTCT TGGCACATCT GTCAAAACTC
554051 CGTCAGCTGT AGATATGTGT ATATATTTCT GCATTCTCTA TTCTGTTCCA
554101 TTGGTCTGTT TTTATAGCAA TACTATAATG TTTGGCTTAA AATAGTGTTA
554151 TATCTTTTGA AGTCAGGTAG CATGATGCCT TCAGCTTTAT TCTTTTGCTC

FIGURE 3GGGGGGG

554201 AGGATTGCTT TGGCTATTTG AGCTCTTCTT TAATTCCACA CTAATTGTAA
554251 AGCTGTTTTT TCTATTTCTG TGGCAAATTA CATTTTGATA GTAATTGCAA
554301 TAAATCTGTA GATTGCTTTG GGTAGTACGG TCATTTTAAC AATATTAGTC
554351 ATTACAATCC ATGAGCATGG GATGTCTTTT CATTTGTTTT TGTCTTCCTA
554401 AATTTCATTC GTCAGTGTTT TATGATTTTC CTCATAGAGA TCTTTTATCT
554451 CCTTGGTTAA ATTTATACCT AGATATTTTA TTTTATACAT TTTAGCTTTT
554501 GAAATTACAT TTCCTTGTTG ATTTTTTTTC AGGTAGTTTA TTATTGGTGT
554551 GTAGAAACAC TGCTGATTTT TATATGTTGA TTTTGTATCC TGTAATTTTA
554601 TTAATTTATT TATGTGATCT AAGAGTTTTT GATGAAATCT TGGTTGGGGT
554651 ATTTTTGGAT ATAAGATTAT ATCATATGCA AAAAGAGACA ATCTGATTTC
554701 CTTTTTTCTA GTTTGGATGC AATTTTTTTT TTTTTTTTTT GAGACAGAGT
554751 CTTGCTCTGT TGCCCAGGCT GGAGTGCAGT GGTATGATCT CGGCTCACTG
554801 CAAGCTCTGC CTCCCGGGTT CATGCCATTC TCCTGCCTCA GCCTCCTGAG
554851 TAGCTGGGAC TACAGGCACC CGCCACCACG CCCAGCTAAT GTTGTGTGTT
554901 CTTAGTAGAG ATGGGGTTTC ACTGTGTTAG CCAGGATGGT CTCGATCTCC
554951 TGACCTCGTG ATTCACCTAC CTCAGCCTCC CAAAGTGCTG GGATTACAGG
555001 TGTGAACCAC CGCACCCAGC TGTAGTGGTA GTAATTGAGA CCTTTCTCTT
555051 CTACCAGTGG GTTTTATACG TTCATGTGTT TTTCTGATGG TAGATATCAT
555101 CCTTTTGTTT CCAGGTGTAG ACCTTCCTTA ACTATTGCTT CTAGGGCCCG
555151 TGTAATAGTA ATTAATTCCC TCTGCTTTTC TTTCTCTGAG AAAACAATGT
555201 ATTTCACCTT CATTTATGAA GGATAACTTT GCTAGGTGTG GCATCTTTGG
555251 CTGCTAGTTT TATGTTTCAG AACTTTGAAT ATATCATCCT ATTATCTTCT
555301 GGCCTGTAAG GCTTCTGCTG GAAATCTGCT GTTAGTATGA TGGGATTTCC
555351 CTTATAAGTG ACTGGACACT TTTCTTTTGC TGTTTTCAGA ATTTCTTCTT
555401 TGCTTTGACT TTTGAGAGTT TGACTGTAAT GTGCCGTGGA GAAGACCCTT
555451 TTCATTACAT CTGTTTGGGG ATCTCTAAGC CTCCCATGTC TGGATGTCTA
555501 AATCTCTTGC TAAACTTGGG ATTAAGTTAT TATTTCATTA CATAGTTTTC
555551 TCTCCTTTCG GTATTGTCTT CACCTTCTGG AACATTGAAA ATTTGAATAT
555601 TTGGTCACTA TATGGTGTCC CATATGTCAC ATAGCCTTTA TTATTTTTTA
555651 TTGTTTTATC TTTATTTTTG TAGACTGGTT TTTGTGAAAA GACCTATATT
555701 CAAGTTCTAA AATTCTTCTT CTTGATCTAG TCTATTCTTG AACCTTTTGA
555751 ATGTATCTTT TTATTTCATT CAATTACTTT TTTAATTCCA GGATTTCTGC
555801 TTGGTTCTTT TTTTATAATA TCTATCTCTT TGGTAAATTT CTTTTTCATA
555851 TCCTGAATTG TTTTTCTGAT TTCTTTGTAT TACTTATCTG TGTTCTATTG
555901 TATCTCATTG AGCTTCTTTA ACATCATTAT TTTTCTCTGA TTTTATAAAT
555951 TTCTTTTTTT TTTTGGAATT TGTTGCTAGA GAATTATTGT GTTCCTTTGG
556001 AGGTGTCATA TTTCTTTGCT TTTTCATGTT TCTTGTGTCT TTACATTTAT
556051 ATGTGTGCAT CTTGTATAAA AGCCACTTGT ATTAGTTCAT TATCATGCTG
556101 CTAATAAAGA CATACCTGAG ACTGGGTAAT TCATAAAGGA AAGTGGTTTA
556151 ATTGACTCAT AGTTCAGCAT GACTGGGGAG GCCTCAGGAA ACTTACAATT
556201 ATGGTGGAAG AGGAAGTAAA TATGTCCTTC TTCTCAAGGC AGCAGGACAG
556251 AGAATAATGA GAACCAAGCC AAAAGGGAAG CCTCTTGTAA AACCATCAGA
556301 TCTCATGAGA ACATGAGAAC TTACTGTCTA TCATGAGAAC AGCATGGGGA
556351 AAACCACCCC CCATTATTCA ATTACCTCCC ACTGGGTCCC TCCCATGACA
556401 CATGGGGATT ATGGGAACTA CAATTCAAGA TGAGATTTGG ATGGGGACAT
556451 AGCAAACCAG ATGGCAAGCT CTGGCCCTGT GGTGGCGGAA TTAGGTTGGG
556501 TAAGCTTGTA CTCACGTTCC CCCATGGGGC ATGACAGTGC ACCCAAATTC
556551 AGAGGGTTGG GTGATGTGAG TTTAGGTCTC ATGCCCCTGA ATACAAGGAG
556601 TTGAAAGCTG AAATGGTCAA TATGATCTGC AAAAGTGTAG GATAGTGACT
556651 ACCAAACTGT CTTCTGGAGA GCCTTTTTCA AAAAAAAAAA AAAAAAAAAG
556701 ACAAGGTTTT GCTCTGTTCC CTGGTCTGGA GTGCAGTGAC ATGATCATAG
556751 CTCACTGCAG CCTCAAACTC CTGGGCTCAA GTGATCCTCC CACCTCAGCC
556801 TTCTGAGTAG CTGGGACTAC CTTTGCCACT ACACCCAGTT ATTTTTTGTT
556851 TTTAAAATGG TCTTACTATG TTGCTCAGTC TGGTCTCCAC ATCCTTTCCT
556901 CAAGTGATCC TCCCACCTCA GCCTCTCAAT TAGCTAGGAT TACAGGCATG
556951 AGACACCATG CCCAGCTGGG AAGTGTTAAT TGTTGCTCCA AGATCAAAAG
557001 TTTCTGTAGT GGAAAGGATG CTGAATTTTG TCAAATGCTT TTTCTGTATC
557051 TATTGAGATG ATGATGATTT CTGTTTCTTT ATTCAGTTAA TACAGTGTGT
557101 CACATTTATT GGTTTTGGTA AGTTGAACCA TCTTTGCATC CCAGGGATAA
557151 ATTCCAGTTG ATCATGGTGA CTGACTATTT TTATGTGCTG TTGAATCTGA
557201 TTTGCTAGTA TTTTGTTGAG TATTTTTTCA TCTACCTTCA TCAAGGATAT
557251 AGGCTTGTAG TTCTGTTTTT TTATATTGTT CTTGTCTGGC TTCAGTATCA
557301 GGGTAATGCT GGCCTTGTAA AATGAGTTTA GAAGTATTCT CTCTTCTTCA
557351 AGGGGAGATT TTAAAAAAGA TTGGTATTTA TTTCTTATTT ACATGTTAGA
557401 TAAAATTCTG CTGTGAAGTA ATAAAGTCTG GGCTTTTCTT TGATGGGAGA
557451 TTTTTTAGTG TTGATTCAGT TTTATTCTTG GTCTGTTCAA ATTTTCTTTT
557501 ATTTTTCTTA ACTTTGTCCT CGTAGATTCC ATGTTTCTAG GAATTTATCA
557551 ATTTCTTCTA AATTATCCAA TTTATAAGCG TAAAGTTGTT CATAATATTC

FIGURE 3HHHHHHH

557601 ACTTATGATC CTTTGTGTTT CTGTGGTATC TGTTGGAATA TCTCCTCTTT
557651 CATTTGTGAT TTGAGTCTTA TCTCTTTTTT TCTTAGTTGG TCTGGTCTGG
557701 CAAAGGGTTT GTCAATTTTC CTTATCTTTT CAAAAGAAAA CTTATTTAGT
557751 TGATCTTTTC TATTCTTTCT AATCTCTACT TTATTTACTT CTATTCTGAT
557801 CTGTATTATT TCCTTCCTTC TGCTAACTTC ATGCTTTGTT TGTTCTTCCT
557851 TTTTTAGTTT CTTGAGATAA CATTAAGTTG CTTACTTAAG AACTTTTCTC
557901 TTTTGTAATG CAGGCATTTA TTGCTATAAA CTTCCCTCTT AGAACTGCCT
557951 TTGGTGCATC CCATAAGTTT AGTATGTTGT ATTTTCATTT TCATTTGTCC
558001 GAGGATATTT TTAACTTTCA TTTTTAATTC CTTCCTTGAT CCATTAGTTG
558051 TACAGGAGTG TGATGTTTAA TTTCCACATA TTTGTGAATT TTCCAGAATT
558101 TCTCCTTTAT TACTTTCTAG TTTAATTCCA TTATGGTCAG AAAATATACT
558151 TGATATTATT TCAGCTTTCT TAAATTTATT AAGAATTGTT TTGTGGCCTA
558201 TTATCTATCC TGTAGAATGT TACTGTGTGC ACTTGAGAAA AATGTGTATA
558251 ATGGTGCTGT TGGATGAAAT GTTCTGTATA TACCTGTTAG GTCCATTTGG
558301 GGTAAAGGGT TGTTGAAGCC CATTCTTTTT CTACTGATTT CTTGTCTGAA
558351 TGAACTATCC ATCGTTGAAA GTGCAGTATT TACTATTACT GTATTATACT
558401 ATTACTATTA CTATATTATA GTCTATTACT GTATTATAGT CTATCTCTTC
558451 AGATTTATTA ATGTTTGCTT TATGTATCTA GGTGCTCCAA TGTTAGATGC
558501 ATGTATATTT TAAATGCTTA TCTTTTTAAT GAACTGACCC TTTTGTTATT
558551 ATATAATGAC CTGCTTTTTC TCTTTTTCCC AATCTTGACT AAAAGGAGGT
558601 CATTCTAATA TAACAATTAT ATAAGCATAA TCACCTCACT CTGTATTGAT
558651 CTAATCTAAT ACAAGCATAA TCACTCCCAT GCTCTATTGG TTACCATCTG
558701 CCTCTTATTC CATACCTTTG CTGTTAGTCT ATGTGTGTCC CTAAAGCTAA
558751 AATAAGATTT TTGGAGGGAA AATATTATTG GATCTTGTTT TTTAATCTAT
558801 TTAGACATTA TTTTAACTGT AGACTGTAAT CTCTTTACAT TTAAAATTAG
558851 TATGGATAGA TATGGACTTA CTATAGGCAT TTTATTAATT TTTTACTGAC
558901 TTTTGTAGTT ATTTTGTCTT TCTTCCAATC TTACAGTCTT TCTTTGTGAT
558951 TTGTGTATTT TTGTAGTAAT ATGCTTTGAT TCCTTTCTCT TCATATTTTG
559001 TATATCTGCC AGAGGTTTTT CATTATAGTT ATCATGAGGC TTGCATAAAA
559051 TATCTTATAG TTAAAGTATT CTAATTTAAG CTGAAAATAC CTTAACTACA
559101 ATTGCATACA AAGACTCTAT GCTTATATTT CTCCTCCCTC ACACATTTTA
559151 TGCTATTGAT GCAATAATTT ATATCTACTT ATATTGTGTA TGCTAACCCA
559201 TTGTTTATAG CTATAATTGT TTAAATACAT TTGTTTTTTT AACTATTATA
559251 CTAATGAGTG ATTTACATAA CCCCTTTACG GTTTTAGTAT ATTCTCAATT
559301 TGAGTATATG TTTACCTTTA GTAGTAAGCT TTATACTTCC ATATGTTTTT
559351 ATATTTTACT TATTTTCCTT TTATTTCAAC TCAAACAATT CCCTTAAGCA
559401 TTTCTTATAA GGCCAGTCCC ATGATGATGG ATTTCCTCAG CTTTTGTTTG
559451 TCTTAGAATG TCTTGATCTC ATTTTTCATT TCTGAAGGAC TGTGTTGCTG
559501 GGTGTAGTAT GTTTTGTTAA CTTATTTTTT AGCACTTTCA ATATGTCATG
559551 CCACTCCCTC CTGGCTTGCA AGGTTTCTGT TGAGAAGTCA TGTATAGTCC
559601 TATGGGAGAT CATTTTTATG TAATAAGTTT CTTCTCTTTT GCTGCCATAA
559651 AGCTTCTTTG TTTTTGGCTT TAATTTGATT ACAATGTTAA AATCAGAAAC
559701 CAATGAGATT TAAGGCAGCA AGAATTTTGA GTTTATCTCT ATTGAGTTTA
559751 TCTTTCTTGG GGTCCTTTGA GGTTCCTGAA TCTGTATGTT CATATCCCTC
559801 CCAAGATTTG GGATTTTTTC AAACAGTATT TCTTTAAATA ATGTATCTCT
559851 GTCTCGCTTC TCCTTTGGAT ACTCTCATAA ATTTTATATT TGTACATTTG
559901 ATGGTGTCCC ATATATCCCT ACACTTTCTT CACTCTTTTT TGATCTTTTT
559951 TTAATTCCTC TAATTAGCTA ATTTCAAATA ATCTTTCTTC AAATTCACAA
560001 TTTCTAATTT TTTTGCATGA TTGCCTCAGC TATTCAAACT ATTGAGTTTT
560051 TCAATTCTGC CATTGTATCC TTCAGCACTA GGATTTCTGT TTGGTTCTTT
560101 TCCACGGTTT CTATATTTTA TCAAACTTCT CATTTCATTC ATGCATTGTT
560151 CTCCTTATTT CTTTTAGTTG TCTATCTCTA TTTGTTGAAT TTCTTTGAGC
560201 TTCTTGAAGA TGAGCATTTT GAATCCTTTT TCCAGTAATT TGTACATCTC
560251 TTTTTTGGTG GGGTTGGTTA GTAAAGCCTT AGTTATTTTG ATGGTGTCAT
560301 GTTTGCTTCA TTCTTTGTTA TTCATGTAGG CTTGCATTTC TGTCTGCATT
560351 TGAAGGAGCT AACTCCTCTT TCACTCTTTA TAGAATAGAT TTGACAAACT
560401 AAAATTTTCT CCTAATAGGT CTGCAGGTTG ATGAGATTAC CTCTGGGCTC
560451 ATGATTGAGT GGCATTGGAT GCAGGTCTTG TGCCTGATAC TGGGTCTACA
560501 GTGGAAACTG CAGTTGGCAG TGTTGTTACC AGAAGCTGTA GTTGGTGTGG
560551 GTCCCATTTG GTTTCTGGGC AGACTGAACT GTCTCCAGAT CTTTGGGTCT
560601 GGATCTGGGA TGATGAAGGT CTGCTTCAGG ATTCACAGAT TGCAGGTCTT
560651 TTTCCACGTG CAATGATGGA TATGGCTTCC GCTGGGTCAC TGGCAGGACT
560701 CCTGTTGGAT AACTAAATGA GTACCTGTCC TAGCCATACT GTACAAATTG
560751 GTGGCTGAGA TGGGCTTAAA CTGAGACATA AGATTGTTTC AGGATATACA
560801 ACCAAGGCTG AGATCTTTAG CCCCCACGAA TAGGTATGTG TACAGTGGTT
560851 TCCTGGATGA GCAAGCCTGC TTTCAGACTG CAGTTTAAAA AGGTGGGGGC
560901 CAATTTATAG GGCCATTTAA AGATCCACAA TGGGACAGAG GTGAGGGATT
560951 CAGCCTGAAT GGGCACTGTG GGACATGCCT TCTTGTGCCC AAGCAGGCCA

FIGURE 3IIIIIII

561001 AGCTTCTCTC AGTCTGAAGA CAAAAGGGGT CTGGACCTAA ATCCAGTGCC
561051 ATTTGAGGAT CCACTGTGGA ACAGAGGTTG GCAAAGCGTG TCAGGGAAAC
561101 AGACAGGCAT GTCTCCTGGT GGGATTCCAG CTGGGCAGAA TTGCTTCAAG
561151 ACCACAGCTG GGAGGGACTG AAACCAATCT TCAGGGCTAT TTTTAAATCT
561201 GCTGTGGAAC TGATGTTGGC AAGCCTGACC CAGTGGCAGT GGGGGGTGAG
561251 AACCCCAATA GATCCCTATG TGGTCAGGAT TGCTCATAGA CTGCATCTGA
561301 GAGGGGCTAG AGCTGAGATT TGGGGCCCAG TTATGGTCTT CTATGGGATG
561351 AAGGCCAGCA AGACTGTCCA AGTGCATCTC TAGCAGTTCC TTGCATGGTG
561401 GAATAACTTC AGGGCTGTGA CAGAAGGGCT GGTGCCTAGA AAGGTCCCTT
561451 CAGGATCTGT TATGGGATGG AAGTTGTCAA GCCCATTAGC ACTGATGGGC
561501 TAGTCACCCT GTGCCATTGG GATTATTCCC AGGCTGCATT TAAGCAGGGC
561551 TACCATCAAG ATTCAGGGCC CCTTCAGGAC CTGCTGTGGG ATGGAGGCTG
561601 ACAGTCTAAT GGCACAGATG GATGAGTCTA CCAGCATGTC TTATTATGGA
561651 TGGGATTACT CCCAGACTAT GGCAGAGAGG GGCTAGAGCT GAGATAGGGC
561701 CCCTTCATGA TCTGCTGTGG GACAGAGGCT GCAAGTCTGT CCTGGTAGTA
561751 TAGATGGGTG AGTCTCTCTC TAGGTCCCTG TGTGAGAAGT ACTAGGCTAG
561801 AATTACAGCT AAAGGGGGCT GGAGCCAAAA GCTGTTACAG GATAGCTTTT
561851 GGGTTCACGG ACAAAACTGA TGGCAAGAAG CAGATGGGTC TGTCTGTGAA
561901 GCACTAATGT GCATGATTCC TCCCAGCCCT TTGGTGGATG CTTTTGGAAG
561951 CAGGCTCAAG CACAAACGGA GCTGTAACTA AACCCTTTGG AAAATGGGGT
562001 TATTTATGGG TCTGAAGCTG GGTCCACAAT TACTGGGTCT GCCACCTAGG
562051 TGCAGGTCTG TACTCTCAAA ACAATAATCC TAGATCTTGG GCTCCACTCT
562101 GGTTTCACAA CCTCATACCC CAATCCAAGG GCTCCCACAA AGAAATTTTT
562151 TATCATGAAT GGGTGCAGAA TTATTTTTTT TTTGTGGAGT AATACAAGTG
562201 CGTGACCACC TATTCTGCCA TCTTATCTCA TCCCCTAGAT ATCTGTTTTA
562251 ATTGCTTCCT CTTTACCCTG TTGGTGAGGG AAGGATTTTG TACCTCAAGA
562301 GATACCTATG GAGACAGCCA AACACACAGA CCCTATATTG GACAGATGAG
562351 ATTGATGCAT ATTTATTAAT CACATACACT TACAGCCCAG AGGAGGGAGA
562401 TACCACACAC CATGCAGGGC CACATAGGGG TTGCATTTGG GAAAAAAAGT
562451 GAACAACCAT GTGTATGGGA TGCAGTTTGG TAACATCAAG AGGGCAGGGT
562501 ACTCGTCGAT ACTCAGGAGG ATGTGATTGG CTTGTTTGAG TAGCTCCACA
562551 GGCTGGCATG GAACTGAAAC TTACTTCTCA GTGATGAAGA AGAACTTGAC
562601 CTGATCTATT TGATAAGGCA GGTTCTTTGG CTAGGAAATC TTATTTACAG
562651 GAGCAGAGTA AGGAAGAATG TTTCCTGTAA GGCTATTTAT GCCCCTTTCA
562701 GATGCCCTCA GCTATCACAG AAGCCAATAA TATTGGGCCT TAATCTTAGG
562751 ACTCGCACCA TAGTATATTA ATGAATCTTA GCTATAGAAA GGGAAGGAAA
562801 GATATGAGAA TAAAGCTATA ATTGGTTTCT TAAAAATTGC ACTCATTTTA
562851 GACAAGAGAC AGGATTTCTG GTGTTTTGGG GTGGCACAAT GACCTTGCCT
562901 TTGTCTGTAC TTAGACAAAA TTATTAAGTG ACCCTACTTT GTCTCATTTT
562951 ATCATGGTCT CAAAGTAGCC TGAGGTTCGT ATTATTTCCA ATAGGGGAAT
563001 AAAATAGCAT AGCTCTGAGA GCTGGGCCAA CTTCCAAATC TCAGAGGCTG
563051 CTATTTATTT TCTTTTTACA GTTAAAAGGG CCTGTTGGTG CTGGGAGGCT
563101 AAATTAGATG GGTTGGTCAA GGAAAGTTTT CTGAGAGAGG GATGTCAAAG
563151 CTCAGCCTTT ATCACTAATA AGGAGCCATA CACATAGAGA AGAACTGAGG
563201 AGAGTAGAGA CAGGAGAGGA AGGGAGACAA CCTGTGGGAG AGCATTCCTG
563251 TCTGAGGGAA ATGGCAAGTA TGAGCAAAGA AACATTTCAT CACACCCAAG
563301 AGGTGTGAGA AAAACCATTG GGACCGTGGC TCTTTGCTTC AATGCTCTCT
563351 AGGGTTGGAT ATGGAGGAAG TACCAGAATC TCAGAACATG GGAAGTAAAC
563401 TTTGGAAAGC CTCAAAGTGA TCCTGATACA GTGGTCCTCC AAGACAGATT
563451 GTCTCTTACT GCCTGTATGC TTCCCTCACA GATTTAGTTC AATTATATAG
563501 ACTTTATATG AAAATCCCAA TACTAATTGA TACTTTAATA TGACCCTGTA
563551 TAACATACAA CAAAATTGCT TGTCCAGGAA TGTTTTACCA ACATCCAGGG
563601 AGATAGATGG GGTTATTAGC TAGTGAATGT GCTGTCAGTG GCAGAAGATC
563651 AATTATCCTA TATATAATTT TGTTTTTTCT CAGAAACTAG ACTGTGGTGA
563701 TTTTTCTAGA CCATCTAACA TATATTTGAG CAAGGTCTGC ATTTCCATTT
563751 AATAGTGAAG CATTCCTAGG ATGTGAGTTT TATCATTCCA ATCATCTGTT
563801 CATATCCAGT TCATGCATTT GAACACTATT ACAATAGTTG GTTTGAAGAC
563851 ACCATTGCTA CCAACTGGGA ATTTAATATG CCAACACAGG AAAATATTAA
563901 CGATGATAAA CAGCTCAGAC AGCAGAGAAT AATGGTTACA AGCATGGACT
563951 CTGAAACCAG ACAGCCTAGG TTCAAATGAC AACACTACCA CTTTCTAGTT
564001 GTATCCCTGT TAGGTACTTT ACTTAGCTTA CATGCCTCAA TTTTCTCACC
564051 AACAAATTGG GATAATACTA GTACCTACCT CAAAGGTTTA CTGGGAAGAA
564101 TAAAATATAT AGTAATTTCT TAGACCTGAC ACAGGATAAC ACTATGTAAG
564151 ACCTACCTTT GTAATGATGA TTACAACTAT GTATTGGAAA AGAAAAAAAA
564201 GGTAATTAAT ACAGTATTCC TATAGTTGAT GAGTTAATTA TGTACTAACC
564251 AGTATATATA AATGTTCACA GATCTTATTG AGGAATAATT CCTATCACTT
564301 ATGGTTCTAT ACAGGGCCTC TCCTCTTTCT ACAATGTCAA TCACATAATA
564351 AATCAGTTTT TAGCAAAATC TGAAACTATG CATTTAATTT AAAATTTTTT

FIGURE 3JJJJJJJ

564401 TTTCCTTTCT GCCTCGTATG TCTGATTCAT TCAAGCCTAC TGTAGATAAC
564451 AGTTTTAATA CATTCTGTTA CTGAGCTTTT TGGACTTTGC CTAGAGAACA
564501 CACTAAGAGT CTCAGATCTT TAATTGAGGC AACCGTATTT AGTACCACTG
564551 AAATAAGTGT GAAAACAGCT TGATCATGCA AAGCTTGACA TGAAGAAAAC
564601 ACCTGCCTGG TGTTAATAAG ATACATGAAT TTCAGACAAC AGAAAACAAA
564651 GAAAATTACC ACTTTGTCTA TCTTGGTAAA ATACCAACAG AATTCTCATT
564701 ATTTTCATGA CATTCAGAAG TTTATTTGAA TTTCTATGAA ATGTGAACAG
564751 AAAAAAATCA TATGGATTAT GGGCTCCTGG TGGGTGAGGG TTTTTAAAAT
564801 ATTACTGGAT TTTTATCCAT ACTATCAGAT TTATTAAGAC AAAGTAAAAG
564851 AAAAAATAAG GAAAAAATAA ATATTTGTTT TGTTCTGGAT ATTCATTAGA
564901 ACAAACCAGA GTGATCTGAG AATCAATTTC AAGTATCTTA ATAGGCCTGG
564951 ATGTATTGGA CATTAGTGTA AACACACATA CCCACTTCTC TTAAGTTTCA
565001 GGGTCTCAAT AGAAATATGT TGAAAGTTCC TATCAATTGG CACTTTTATG
565051 CATAAGAGAA AATCTTTTAC TTTCACAAAC CTACTTTAGT TGTTTAAGAA
565101 AAGGAAAAAT CTTAGTAATA ATAATACAAC AGTCATTAAA GGAATAACTT
565151 AGCGCAGATA CCATCTTCTG ATAATCACCC CTCAGAGCCT TGATTCTAGG
565201 CTGTGACATT ATCAGTTTGC ATTGGTCACC AAACAGCTTT GACATGGTAT
565251 TACCTAAATC ATTGCATTAT TACAAGCACA ACTGAAAAAC TACAACTTCT
565301 TTTTTTTTTC AGTGAAGTCA GGAAATTCAT CCTCCAACAG GTTGAGAGAA
565351 TCACTAAGAA AAAAAAAACA GGATTATTCT TGTGTTTGTT GCCAAATTTA
565401 TACAAGATTT ATAAAACGCC AATATCATAT GCACTGAATT TTCAGTGTTT
565451 TTTGTTTGCT TGCTTCTTTG CCTGTTTGTT TAACATATAT AGAATAAATT
565501 ATCTTGTTAG ACTGCTTTCT ATTTCTAATG GACATGTGTA CACATAATTT
565551 TTTGGAAGCA AAGTTACGCC TTGTTTCCTT CCTGGTTATT TATTTTGCCT
565601 AAAAAATCTT AGTACCTACA CCAAAAGGTA GTTAATATTC ATGCATAGTC
565651 AGCATTTAGT TGACTGTGAT AAATTGTCAA AAGAAAGGAT AATTGAAATC
565701 TATTGTACTG CCAAATCTAA TTCGATATTC TATGCTTAAA CTTATATTGT
565751 GTCTTACAGT TGGCCATAAG TGCTAATAGA CCAACTGAAG ATATTTTAAT
565801 TTTAATTTCT TTCATCCTTC CAAAGATTTT GATAACTTAA AACTTGTATG
565851 AATAGTACTT TACAGTTTGT AAGCATTTTG ACATAAATTG TCACTTTTGA
565901 TCTTCCCAAT ATCCTTATGG GAATGAGAGA TTATAGGATT ATGGAAGATT
565951 TTATTATTCT CACTTTATAT ATTAATAAAT TGGGAAACAG TCATCATGTT
566001 CTTAAGGAAA TGCAGGTAAT CAGCTCTAGA AAAATTAAAA GTCTAGAATT
566051 TCAAAGTTTG TTGAATGCAT TACATTGCAC TGAGAAAACC CATTACCTTT
566101 TATCCACAAT AACCCCTTCT GTCTCCTTGC TGCCCTGTGT CCATGTCATT
566151 CTCTCTACTG TTTCTGGAAC TTTGAATGTT TTTCTTCACT TCCCTTACTC
566201 CTTTTATGCA CACTGTCTTG AATGTCCCTG CTTCTCTCAA ATACCTAAAT
566251 CCTGCTCATC TCTCAAGGTC TAGCATAAGT TTCATCCCCT CCAGGAAGTC
566301 TTCCAGCCCC CACTGTTCTT ACTTAACAAA TATAGCACTT ACAGGAATTT
566351 ATTAAGTTCT TAAATGTTTA ATTTATGTGC ATCTAAATTC TCCTACCAGA
566401 TTATAAGCAC CTGAGAACAG AGACCAAGTC TTATACTTCT TTGAAACTCA
566451 CAACATTCTA GCACTGGATA TAGATATAAT AAATGCTTGC TAAATATTTG
566501 GTTATTGTTT AATTACCCAA TGGAGACAAT GCTGAAACAT ATCTCATCTT
566551 CCTTATCTGC ATTTCCATCC ATGTGGCTTG TAATGTAGCC TGTATAATCA
566601 CTTACTATGG TAGAGTTCAG TGTGGGTTTT TTCAATACGT TCATACATCA
566651 ATTGACCCTA ACATTAATTT CTAACTGTCA ATGACGCCCA GTCATATGAC
566701 CTAGGGGATC GAATTAACTA CACATTCCTG ATGGATTCCC TGAATAGAGT
566751 AAACATTTGG GCCATATTTC AGCATTGAGA ACAGGAACAG AAGACATTAT
566801 GCTGTGATTG CATTTCTATA GAATTACATT AGCATTACCC ATTCTGCTAG
566851 TCATAATTTC TCAGCAGATC AGGGATATCT ATCAATAGTA TTTCCTGTGA
566901 TATAGCACAT GAAAATGCAT TCCATTATTC ATTAGAAGTG TTGCTGATCA
566951 AGTATATTAT CCTTATAAAC TTACTCTTTA AGAAAGAAAT GTTTATATGA
567001 AAATAACATA CTTAAGAGTC ATTATGTGAA AAAAGTATGT CACTGTATGA
567051 CAGTTTGACT CTTCTGAAAT GTAAGTGTTC GGTTTAATCA AATAACTGCT
567101 TTTGTTCATA TTTTAAGGTG AATTTGGAGA AGTCTGTAGT GGGCGTTTGA
567151 AGACACCAGG GAAAAGAGAG ATCCCAGTTG CCATTAAAAC TTTGAAAGGT
567201 GGCCACATGG ATCGGCAAAG AAGAGATTTT CTAAGAGAAG CTAGTATCAT
567251 GGGCCAGTTT GACCATCCAA ACATCATTCG CCTAGAAGGG GTTGTCACCA
567301 AAAGTAAGTT ACTGAGTTTC TTCATTACTT CTTTCACACA CCTATCTCAG
567351 TTTTTTTTTA AGAAAAGGAA AAATCTTTCA TAATAATACC ACAGTCATTA
567401 AAGGAATAAC TTAGTTCAGA TATCATCACC CCCTCAGAGA CTTGATCCTA
567451 GGCTGTGACA TTATCAGAGT TTGCATTGGT CACCAAACAG CTTTGACATG
567501 GTATTACCTG CAAATCATTC CTAACATAAC TTAAAGTAAT GAATCAAGAG
567551 TAAAGGGTTA TGTGTTTTTG CTTTGTTTTG TTTTGTGTTT TGAAATGTCA
567601 ATAGTAACAG AACAAACACT TTCAGTGTTT TGGGTCATTA AGGTAAAATA
567651 TTTCTGTTTA GAAATAAATG TCATATACAA ATATAAAATG CTTTACCTGG
567701 AGTAAAACTT ATAAACAAAA ATTCGGCATG GAACCTATAT AAATGGCATT
567751 AGGAGTAAAT TATTATAATT TATATAAAAT GAAAAAAGTT TACAATTCCT

FIGURE 3KKKKKK

567801 CAAGTAAAAA TTCTTCTTTC ACAGAAATAA TGGAACAAAG TTTATTCCTT
567851 TGAAAAGAAA TGTTTTCAAA AATCCAAAAT TAGCAATATC CTCTAAGAAA
567901 TAGATTGCTA TATATTCACT TTCATTTGAA AAATGATAGG GCATAAAATA
567951 TGACAATATT TCTCATTACT TTATTCACTA AGAATTATTA TATATAAAAT
568001 CCAATACAGA TTTGGCCTTT TAAAAATAAC TTCAATCCTT GAAAGAGGCA
568051 TTTTTCTTTC ATAAAAATAA CATTTATTTT AAAATCTTTT AAATAAAATT
568101 GTAACTTTAT GTCATATTTG GAAGCAGGAA AGTATAAAAG CTTACTAAAG
568151 AGGTGCAATT GACTCTGTGT CTGAAACACC TAAGTCCTTC TCACAAGGCA
568201 TTGTCCAACA TGCTACCCAA AATGAATAGA TTCCTGACAG CTATGAAAGT
568251 TTGGAAGACA GAAAAGAATG CTTCTGATGA CAGATGTTGC AGTGGACTAT
568301 TACTTTAGTG GCCTTAATGG GGCATTTCAG TGTTCATGTC GTTGTGTAGT
568351 TTTTTCCCAT ATTGATTCTG GGCTTTTCTA TGTAACAAAC CTTGGCCAAT
568401 GGGACATTAG CAAGTGTGAT GCAAGTAAAG GCATCTTACA TGTTTGTACG
568451 TTGGAGCTTG TCCTCTTGCC ACACTCTTTC CTGGAACGAG TCTCTATGCC
568501 TAATAAAGGC AATCCATAAG ATGAGGCCAC ATGCAGTACT CCAAAGAAGA
568551 GAACTGAGGT GATTCAGCCA ATATCCACAT CTGAACTCCA AGCGGAATGT
568601 CAGCACTGAA TGCAGCCTTG TGAGTGAACC ATCTCTGATG TTACAACTCC
568651 ACTACAACTG CTATTAGATA GCTATAGCTG TGGTTGACAT CTTGTGCAGG
568701 AAAGGAACCA TGCACCTCCA TCCCATCAAC CCATAAATCA CAAAAGATGA
568751 TTAAATGGTT GTTGTTTTAA GCCACTAAGT TTCAGATGGT TTGTTGCACA
568801 GCAATAGATA ACCAAACAGA TGGACCCCAG TTAGAATTCT GCTCCTGCCA
568851 CTTAAGAATT ATGCAGCTAT GGGTAAATTA CTTAACATCT GTATCCTTTA
568901 CTTCCACATC TGTAAAATGG GACAGGAATG CTGTAAGAAT TAAATTTGTC
568951 AATGTGTAAT ACATTTAGCA CCCTTTGTGC ATCATTGTAA ACCACATTCA
569001 ATAATATTCT TTATTGGGAC TATATGTGCT AGCACTTTAT ACGTATACGT
569051 TACCATTTCA TTCTCACAGC AACCCTAATT GATATCATTA TCTACATTTT
569101 ATGTATGAGA AACGAAGGCC CAGGCAGGTT AACTAACCCA CATAAGGACC
569151 TTTAACCTAC AGTATGTGGC ATGACTAGTG TTCAAAATGA AGTCTGTCTC
569201 ACTTTAAAAC CCACCCCCCC CTTTTTTTTT TTTTGCTTTT GCTATATCCC
569251 TTTGAATGAG TTTTATACTT TAATTATCTT ATTTGAATTG AACAACATTA
569301 AATAAATAAC AATCTGAATT AAATAACATA ATTCTGCCTT TCAGAATAGG
569351 AAAAAAATAT TCAGGTAGAG TGATGTTAAT TGCCCCTAAG ATATAAAATT
569401 TGGAAAGAGC CAGCTATGCC ATAACACCTG GTAAAGATTA TGACCTAAAA
569451 GAGAGAAACA GAGAGACAGA AGAAATAGAT GTTAATTATT TCTTTCATAT
569501 TTTCTGACTT CCTTGTTATT AATTTAACAT GAACATTTCA AGTTATTCCT
569551 TCTGTATTAT ATATCTCTGG CAGGCAAAAG ATAATTTTCA AGTTGGGTTA
569601 TGAACCTTTG CAGAGCATTT TAAATCACAA TTTAAGCATG ATGTTGAAGT
569651 CCTCTGATGT GTGTTTATGC ATGAAACATC TGGAAATGAG CATCCAACAA
569701 TAAATTAAAA GGTTTAAAAA GCGTCATATC TTTATTTTCT TACTTTAATA
569751 AATCAAATTA TGCCTTTCTC CTTATATGTG AATTACACAT CTATCCTTTC
569801 TCAATCACAG ACACACACAC ACACACACGA AAAGGAAAAA AGATGTATAT
569851 CCCTGTGAAA TAGTGGGAAT CATTTATCCT ACATCAACTA AATATGTTTA
569901 ATAAGGTATT ATGTGGTACT TGCCTGCCAG TTTGAAATAG TTTATTTCAC
569951 ATAAGCATCC AACATAGTGA TTGCTTTACA ACTCTAAGAA TCTCATCTAG
570001 AAATGAGACC AGTGACCTCT ACTTAGCCAC ATTTATATGA TTTACAAGTC
570051 AAGGTTTTTG TTCCACTTCT TAAAAAAAAG AAATAAAATA AAAATCTCAT
570101 ATCTGTTATA GGAAAACGGA TTGAGAAAGG ATAGATTCAG TATACTGTTG
570151 AGTGACAATC ACCATTGTAG CATTAACTTG TTAGAGTGAG CCCCGTATAG
570201 GGTGGTGTGG AGCTACCAAG GTGGGTTGTA GAGATGGAGA AGGGAATAAT
570251 CCTCGTAAAG ATAAATGGGC AGGTTTATAT TGTTATCATC TTGACTCAAG
570301 TGCTATGGGA CTGTTAGAAG AAAGCCAATA AATAAATGAG TGCCTCATTC
570351 CCATAAATTC ATAGTAATTA TTCCAAGATT ACCCTTAAGT AGCTAAGAGA
570401 TAGCTAGCAA TTAATGCTCC CAAAGGACTA CCCATTGCAT AAAAGATAAT
570451 ACTGATCAAG ATAAAGATGC AGTATAGGCT TATAAGGGCA TGTTTGTAGA
570501 GTATCCTGGG ATTCTGAGAA ATAAATTCAT AGACTCTCAG TTGAAAGTAA
570551 TTCAAAATCT AGATCAAAAT CTTCATCAGA TTCTTTTACA AATTCTTAAT
570601 ATGCATTTTT TTTTATCTCA TATAGGATTT ATCTCTGAAA GACAAGTGTT
570651 ATAAAGTTCT TGGGAACACT TTGGCTCTCT TTCATATTTG GGCATTATTT
570701 TAAACTTAAA AGTTAAATGA TTAAAAGCTG TATTATCCAA AAAACTGTGT
570751 TTGATAAGAG TTGAACCTAT TTGTTTGATA TGCATCACAA TTTCATTAAC
570801 CTATTAAGAT ACAAGTGATA TAAAAAGAGA TTAATTGACC CATAACCATA
570851 TGCTTAGTAC ATACTTTTTC TCCAAGAAGC AAATAGAAGC CATAAGTTAG
570901 AGGACAGACT TGTAGCCATT AATAGCACAG ATAATAGCAA TTTGTAACAG
570951 ATAACATATA CACCGGTGTC ATTAACTATA TAACCAACAG AGAAAGAGCT
571001 ACGGTTCTAC AAAAAAGCAA GAACTATGGT TTAATGATGA AGAAATACTG
571051 TGCAGTAACC ACACTTCAGA ATACTGGGCT CTGCAGTTTG AATTTATGAT
571101 GATGGAAGAA CCAAAAAGTA GTAAAAATGA AGTGCCTACC TCCCAGCTTA
571151 GACAGCAACA ACTAAATTTA GATATGCCAA CTGTATCTAA AATAAATCCT

FIGURE 3LLLLLLL

571201 AAATCCAGTA AAGAGCAATA GAAACCAATC AGGGTAGCAA ACAAATTCCC
571251 AAACATAATT TCATTTCATA AAAATATTCC CTAAATATTC CATGAGACAG
571301 TATTGAAGTT ATAACAGAAA GTGCTGCGCT TGCTCAAAAC CCCCTTTAAT
571351 ACTCAAGAAT ATTGTGGGTT CCTTCTGGAG AGGCAGAGTG GGTCCACATG
571401 GGATCTGGGT AAGAGAGTAG ATTCAAGCCA GCCAAATACA TTTTAGTACT
571451 TGCACAAAAA CTGCTTCTCT GGTTCCAGAA TTTTGTTCTG CTTGTTAAGT
571501 AATAGGCATT CCCCAAAATT TCTGCTACTG TATTACTGTA TTAGCTATGA
571551 CATCTGCTGC TCTACCTGGT TATATTTGGG ACAGTCCCAT AACCACTTTG
571601 GGCCTTAATT TTCACCACCA CACACAAAAA AACGAAAAGT GTAAGTAAAT
571651 TAGACTAGAA AACATTAAAG GTCACATTTA CCTTTAATAT TTTGTGATTC
571701 CATTTTGTTT TTAAAAGAAG AGTCATGAGA TGTTGGTGAG GTTTAAAATT
571751 TGTGCCAGTG ATAACTTACC ACTCCACCTC CAACTTTATT ATAACTTCAG
571801 GTGCATATTG ATGACCCAAT AAGAAAATAG AAAAGTTCAG GAAGAAATAA
571851 GCAAAGAAAA AAACAGTGCC TTTGATAAAG TTTTCAACTT ATAATTTGTA
571901 AAGTAGAAAA GTTATAGGTA AAATTTTTCT GTAAGTAAAA TCAAGGTTGG
571951 GATATGTATA ATATACATTG TATGGGGTAA AATATTCTGT ATGTCTGATT
572001 TTACTGATAT ACATTAGATT TTTTTTACCC CTGAGGTTCA GCTCCTAGTT
572051 AAGGTAGGTT AAGAGTCTAT TGGTTTTTGT TCTTCCCCCA AACCCAAGAA
572101 ATATTTAGTG AGTTTGACCA GGTATTAGGC CCTATTGCTG ATTAAAACCT
572151 AGTGATAGAG AAAAGAAGGC TCAGTGCTCT TGAGAAGCCC ATTTGTTGGT
572201 GCCAGTCCAC TGGGAGCAAC AAATAAGTGT GTCATTATTT CCCAATATGG
572251 TGTGGTGTGT GCTGTTTTCG TTATAATTAT TCAATAATTT TTAAATTTAT
572301 TCATTCAGCA AATATTTATT TAGTGTCCAT TTTTCTAGTC AACTTTTGTT
572351 TGTTTGTTTG AGACGGAGTT TCACTCTGTC ACCCAGGCTG GAGTGCAGTG
572401 GCACGATCTT GACTCACTGC AACCTCCACC TCCCAGGTTC AAGTGATTAT
572451 CCTCCCTCAA CCTCCCAAGT AGCTGGGATC ACAGGTGTAC GCCACCAAGT
572501 CCAGCTAATT TTTGTATTTT TAGTAGAGAC AGGGTTTCAC CATGTTGGCC
572551 AGGCTGGTCT CGAACTCCCA ACCTCAAGTG ATCCACCTAC CTCGGCCTCC
572601 CAAAGTGCTG GGATTATAGG CATGAGCCAC AGCACCTGGC CTCTAGTCAC
572651 TGTTAATACA GTAATGAAAA AAGACAGAAC TAACTGCTAG AGGAGACAAA
572701 AAGAAATCTA AATATTTAAA TGTAACTTTA GGTAAAGAGC AAAAACCTGA
572751 ATGCAGGGAG GGAGCAAACC ATGCCTAGGT GTGATAGAAG AGTATTCTAG
572801 AGAGAGGAAA CCACTAGTTA CATACTTTTG TTTTAAGAAA GAATTTGGCA
572851 TGTTAGAGGA GCACCTAATA AGCAAAGTAA TAATAGTGTG GATTACATAG
572901 TGAAAGGAGA AACTAGGGGC AGACAAAATA TAAGGAGGCT AGTGTAGTAT
572951 TCCAAGTAAA AAATAAGGAG AAAATAGAGT AAAGAAGTCA AGAGAAAAAG
573001 AAAGGGATAG ATTCTAGATC TACTTCCTAG GTGAAATTAA GACACTTCAG
573051 TGACTTCTTG ATTGTATAGG GGGAATGAGG ACGATGGAAC AGTTTCAAAT
573101 GACTTCCAAG TGAATGGTTT CCATAAGTAA AAAGATGGAG AGGGAATTCT
573151 GGAGAAATAA CAGATCTAGA GGGAAAATAG TGAATTCTTA TTTGGACATG
573201 CTAAGTTTAA GGTGTCTGTG ACATTTAGTT AAAGACTTCC AGAATGTCCC
573251 TGGAGCCTGA GTGGGCTGCA GGTTCAAAAG AAGGAGAACT CGATAGATGG
573301 CTGATGGTTG GTAGTTGAAG TCATAGGGAG GATGAGATTA CCCAGAAGAT
573351 TGAGGAGAAC TAGCATTAAG AGGCCAACTG AAGAAGAGAA GTGTATGAAA
573401 AAGACAGAGG AGCAACCTGA AAAGCAAAGG ACAGGTTTCT AAGAGTGAGA
573451 GAGAGGTCAA TAGAATAAAA TGAGCTGAGA AACCAACTTA GATGGATTGA
573501 GAAGCGTCCA TTGGATAGGG CAGAGGGCAC AGCTCATGAA GCATATCATG
573551 GGAATGGAGG CCAGATGGCA ATGGATTTAG AGTGAGATAT GTGCACACTG
573601 CAATCAGATT CAAAGATGTT AAAATGCAAA TTAGATTGTG TTGATTCCTT
573651 ACTTAAATTC CAAATGTTCA GCATTTTTCA GTTAATCATT AATCTAGTAA
573701 TATTTATGAA CTGCCTAGCT ACTACATACT GGACACTTTC TCTCTCTTTC
573751 TTTCTTTCTT TCTTTCTTTC TTTCTTTCTT TCTTTCTTTC TTTCTTTCTT
573801 GCTTTCTTTC TTTCTTTTTC TCTTTCTTCC CTTCCTTCCT TCCTTCCTTC
573851 CTTCCTTCCT TCCTTCCTTT CTTTCTTTCT TTCTTTCTTT TTCTTTCTTT
573901 CTTTCTTTCT TCTTTCTTTT TTTTTTTTGA GACACAGCCT CCCTCTGTTG
573951 CCTAGGCTGG AGTGCAGTCG CAAGATCTGG GCTCACTGCA ACCTTTGCCT
574001 CCCTGGTTCA AGCAATTCTC CTGCGGCAGC CTCCTGAGTA GCTGGGACTA
574051 CAGGCACATA CCACCATGCC TGGCTAATTT TTGTATTTTT CGTAGAGATG
574101 GGGTTTCGCC GTGTTGGCCA GACTGGTCTC AAACTCCTGA CCTCAAGTGA
574151 TCTACCTGTC TTGGCCACGG GAAGTGCTAG GATTACAGGC ATGAGCCATC
574201 ACACCTGCCG TTCCAGGCAC TTTTCTAAGC ATTAGGTGTT CAGTAATGAA
574251 TAAGAAAGCC AATGTGCCTG TCGTACCTGG GTCAGGTCCC TGAGTCTACC
574301 TCCTCTGGTT TCATTGTCCA CCATTCTTCT TGAATCCTAG ATTGCCATTC
574351 ATGATGAATG ACAATGGTGT CTCCAAACTT GCTCCTCATT TCTCCCAGGT
574401 TTCTCTTCTT TTTCTAAATC TGCAAGGAGC TAGAAGACAA TGGCCCAGGC
574451 TGATCCTAAA TGGGTACAAA AGTAAATAAC TGTGATATGA AAAGGATTGT
574501 GGTATCTATA ACACTCAACT TCCTTTCAAG ACTGGAGTTA GCAGTCTTCC
574551 TTTATTTCAA TGATGTGAGA AGCAGGATCA TTTGCTGAGG TGGACAGCAA

FIGURE 3MMMMMMM

574601 GACTGAGGAT TGAGATGCTT GTGAATGCTT GAAGTAGCTC CCATGAAGAA
574651 TGTGAAAGAA AGCTGACCAG GAAATAATAG AAAGATTGAG GACATCACTG
574701 AGGATTCAGG AACCTGGAGA TCATGACAGA AGCTGCTGCC CCAAAAAGCA
574751 CTGTTATTAA TTAGGGAAAG AGTTATAGGA TGAAGATGAG AAGAGATTAA
574801 ATCCAAGGGA AAAGGGAAAA CTGGGAGGCA GCAGCAAGAG AAGAAATGGT
574851 AATTTTCTGT ACTTTCTCTG TTCTTCTACC AACCTTAGTA CTTTTTGCTG
574901 TTGTTCAAAA AATAAATGGT GATTTACTGT GCTTTCTCTC TTCTACCAAC
574951 CTTAATACTT TTTGCTGTTG TTCAAGAAAA TAAATTATTC TTGTGCAATT
575001 TCTAGAGGCT TGATGGATTC TCAGGACATT TACTGGGAAC TATTTGCCAT
575051 GTGGAATTAT AATGTACACA TATTGATAAA CAGAAAACGA ACTAAGTGTG
575101 ACTGTAACAG TGACTAGATG ACATAGCCTG ATGACCCTGT GTATCACACT
575151 CTGTTCAAGC AGGTCTAGGG ATAATTGGAA TCACTGGCTT ATTTTCTCTC
575201 TTCCAGAGCA CACTTCCCTT CTTATAAGAA AAGAATAAAC TCTTTCTGTA
575251 TGCAGGAATA ATTTATTGGT TGTCCTTCTA GTGTTTAAAT ATCTGGGTTT
575301 TCTCAAGGTC ATTCATTCAA ATCACCTCCC TAGAATTACC TCTAACCTAT
575351 TCCCTAGTTC TGTGGTTTTC TCCTGCCCCT AAACTATGCT GCTAATTGTC
575401 GGGTAGACTA CACTATGTAG TAACAGCTGT AAAAACATCT AGTAACAAGT
575451 TTCTCAGTGT GAAGGTATCA TTGTAAACAG TAAGAGCCAA AAAAAGAAGA
575501 GAATATAAAT GCACTTTTAT GCATACATAA TGTTTTCTTT TATACTGCTA
575551 AATAAAATTG AATAAAGCCA TCTAAAGGAT GAAATCTTAT TGACTTTCAA
575601 AGAATAAAAA ATCTCTCCCA AATCATTCAT GATATGATTT GTTCTAGATA
575651 AAGAGTGTGA TAAATCCAAA TTGGGAAGGG CTGTAGATAA ACCCATATTA
575701 CAGGCATGAA TTCGCATCCA GGAATTCAGG AGAGTAAGAA CCAACCTGCC
575751 AGGCTGCAGG ATAAGGCAAT CAATCATCAC TGAGAAATCT TCACCAAGTT
575801 TCTAATGGTC TTATGTAGGG CTGGATAAAA ACCGGTAAAA ATCTTCATCA
575851 CTGAAAATTT AACAGACCCC CTTTTAATGC AATTTCTAGT TAAAAAAAAT
575901 CCATGAAATT AACAAATGAA AATCTGGTAA GGTCCTCATT TAATCCAATG
575951 ATGACATTTT AATGCTAGTT TTCTTGTGGT TGCTGCTGCT GTTGTCAGAA
576001 TATGTTACCG TGCCATTTTT CAAATTTTCA TTTTGGTATA ATTTCAGTCT
576051 TATAGAAAAA GTTGTAAAAA TATTACAGTT CTCATATAAC CTTCACTAAC
576101 TTTCCCCTGT AATTTTAGTA TTTTGCATAA TCATAAGATT ATTTTCAAAA
576151 CCAAAAAATA AATATTAGTA TGGTAGTATT AATTAGGTTG GTGCAAAAGT
576201 CATCATGACT TTGCCATTAA AACTTAAAAG ACTTTTGCAT CAACCTAATA
576251 CTAAACTATA GACTTTCATT CAGGTTTTGT CAGGTTTTTC ACTAATGTCC
576301 TTTTCGCTGC TCCAGGATCC AGTCCAGGAT CCCACACTGC ATTTTGTTAT
576351 CACGTCTCAT TAGTATTTTC AAATCTGTGA CAATTCTTCA ACCTTTCCTT
576401 GTCTTTTATG ACCTTGAAAC CTTTCATGTG CACTAATCAG TTATTTTGTA
576451 GACTGTCCCT CAGTTCGGGT GTGTCTTGTT TTCTTTTTTT TGTTTTTTTT
576501 TTTTTGTTTG TTTGTTTTAA AGAAGTTTGT TGTTGTTGTT TTTAATTTTT
576551 AAAAATAATT TCAACTTTTA TGTTAGATTC AGAAGGTCCC TGTACAGGTG
576601 TGCTGTATTA GTCAGGGTTC TCTTAGAAGG ACAGAACTAA TAGGATATAT
576651 ATATATAAAG GGGAGTTAAT ATTAAGTATT AACTCACATG ATAGAAGGTC
576701 CCACAATAGG CCATCTGCAA GCTGAGGAGC AAGGAGAGCC AATCTGAGTG
576751 GCAAACTGAA GAACTTGGAG TCCGATGTTC GAGGGCAGGA AGCATCCAGC
576801 ACAGGACAAA GATGTAGACT GGGAGGCTAG GCCTGTCTTG TCGCTTCATG
576851 TTTTTTTGTT TTTTTTTTTT TATACTTTAC GTTTTAGGGT ACATGTGCAC
576901 AATGTGCACC TTTGTTACAT ACGTATACAT GTGCCATGTT GGTGTGCTGC
576951 ACCCATTAAC TCATCATTTA GCATTAGGTA TATCTCCTAA TGCTATCCCT
577001 CCCCTCTCCC CGCACCCCAC TACAGTACCC AGTGTGTGTG ATGTTTCCCT
577051 TCCTGTGTCC ATGTGTTCTC ATTGTTCAAT TCCCACCTAT GAGCGAGAGC
577101 ATGCGGTGTT TGGTTTTTTG TCCTTCTGAT ATTTTGCTGA GAATGATGGT
577151 TTCCAGTTTC ATCCATGTCC CTACAAAGGA CATGAACTCA TCATTTTTTA
577201 TGGCTGCATA GTATTCCATG GTGTATATGT GCCACATTTT CTTAATCCAG
577251 TCTATCATTG TTGGACATTT AGGTTGGTTC CAAGTCTTTG CTATTGTGAA
577301 TAGTGCTGCT ATAAACATAC GTGTGCATGT GTCTTTATAG CAGCATGATT
577351 TATAATCCTT TGGGTATATA CCCAGTAATG GGATTCGTGG GTCAAATGGT
577401 ATTTCTAGTT CTAGATCCCT GAAGAATCAC CACACTGACT TCCACAATGG
577451 TTGAACTAGT TTACAGTCCC ACCAACAGTG AAAAAGTATT CCTATTTCTC
577501 CACATCCTCT CCAGCACCTG TTGTTTCCTG ACTTTTTAAT GATCGCCATT
577551 CTAACTGGTG TGAGATGGTA TCCCATTGTG GTTTTGATTT GCATTTCTCT
577601 GATGGCCAGT GATGATGAGC ATTTTTTCGT GTGTTTTTTG GCTGCATAAA
577651 TGTCTTCTTG TGAGAAGTGT CTGTTCATAT CCTTTGCCCA CTTTTTGATG
577701 GGGTTGTTTG ATTTTTTCTT GTAAATTTGT TTGAGTTCAT TGTAGATTCT
577751 GGATATTAGC CTTTTGTCAG ATGAATAGAT TGCAAAAATT TTCTCCCACT
577801 TTGTAGGTTG CCTGTTCAGT CTAATGGTAG TTTCTTTTGC TGTGCAGAAG
577851 CTCTTTAGTT TAACTAGATC CCATTTGTCA ATTTTGTCTT TTGTTGCCAT
577901 GCTTTTGGTG TTTTAGACAT GAAGTCCTTG CCCATGCCTA TGTCCTGAAT
577951 GGTATTGCCT AGGTTTTCTT CTAGGGTTTT TATGGTTTTA GGTCTACCAT

FIGURE 3NNNNNNN

578001 TTAAGCCTTT AATCCATCTT GAATTGATTT TTGTATAAGG TGTAAGGAAG
578051 GGATCCAGTT TCAGCTTTCT ACATATGGCT AGCCAGTTTT CCCAGCACCA
578101 TTTATTAAAT AGGGAATCCT TTCCCCATTG CTTGTTTTTC TCAGGTTTGT
578151 CAAAGATCAG ATAGCTGTAG ATATGCAGCA TTATTTCTGA GGGCTCTGTT
578201 CTGTTCCATT GGTCTATATC TCTGTTTTGG TACCAGTACC ATGCTGTTTT
578251 GGTTACTGTA GCCTTGTAGT ATAGTTTGAA GTCAGGTAGC GTGCTGCCTC
578301 CAGCTTTGTT CTTTTGGCTT AGGATTGACT TGGCTATGTG GGCTCTTTTT
578351 TGGTTCCATA TGAACTTTAA AGTAGTTTTT TCCAATTCTG TGAAGAAAGT
578401 CGTTGGTAGC TTGATGGGGA TGGCATTGAA TCTATAAATT ACCTTGGGCA
578451 GTATGGCCAT TTTCACGATA TTGATTCTTC CTACCCATGA GCATGGAATG
578501 TTCTTCCATT TGTTTGTCTC CTCTTTTATT TCCTTGAGCA GTGGTTTGTA
578551 GTTCTCCTTG AAGAGGTCCT TCACATCCCT TGTGAGTTGG ATTCCTAGGT
578601 ATTTTATTCT CTTTGAAGCA ATTGTGAATG GGAGTTCACT CATGATTTGG
578651 CTCTCTGTCT GTTATTGGTG TATAAGAATG CTTGTGATTT TTGTACATTG
578701 ATTTTGTATC CTGAGACTTT GCTGAAGTTG CTTATCAGCT TGTGGAGATT
578751 TTGGGCTCAG ATGATGGGGT TTTCTGGATA TACAATCATG TCATCTGCCA
578801 ACAGGGACAA TTTGACTTCC TCTTTTCCTA ATTGAATACC CTTTATTTCC
578851 TTCTCCTGCC TGATTGTCCT AGCCAGAACT TCCAACACTA TATTGAATAG
578901 GAGTGGTGAG AGAAGGCATC CCTGTCTTGT GCCCATTTTC AAAGGGAATG
578951 CTTCCAGTTT TTGCCCATTC AGTATGATAT TGGCTGTGGG TTTGTCATAG
579001 ATAGCTCTTA TTATTTTGAG ATACGTCCCA TCAATACCTA ATTTATTGAG
579051 AGTTTTTAGC ATGAAGGGTT GTTGAATTTT GTCAAAGGCC TTTTCTGCAT
579101 CTATTGAGAT AATCATGTGG TTTTTGTCTT TGGTTCTGTT TATATGCTGG
579151 ATTACATTTA TTGATTTGCG TATGTTGAAC CAGCCTTGCA TCCCACGGAT
579201 GAAGCCCACT TGATCATGGT GGATAAGCTT TCTGATGTGC TGCTGGATTC
579251 GGTTTGCCAG TATTTTACTG AGGATTTTTG CATCGATGTT CATCAAGGAC
579301 ATTGGTCTAA AATTCTCTTT TTTTGTTGTG TCTCTGCCAG GCTTTGGTAT
579351 CAGGATGATG CTGGCCCATA AAATGAGTTA GGGAGGATTC ACTCTTTTTC
579401 TATTGATTAG AATAGTTTCA GAAGGAATGG TACCAGCTCC TCTTTGTACC
579451 TCTGGTAGAA TTCGGCTGTG AATCCATCTG GTCCTGGACT TTTGTTGGTT
579501 GGTAAGCTAT TGATTATTGC CTCAATTTCA GAGCCTGTTA TTGGTCTATT
579551 CAGAGATTCA ACTTCTTCCT GGTTTAGTCT TGGGAGGATG TATGTGTCGA
579601 GGAATTTATC CATTTCTTCT AGATTTTCTA GTTTATTTGC ATAGAGGTGT
579651 TTATAGTATT CTCTGATGGT AGTTTGTATT TCTGTGGGAA ATTTGCGTCT
579701 ATTTGATTCT TCTCTCTTTT CTTCTTTATT AGGCTTGCTA GTGGTCTATC
579751 AATTTTGTTG ATCCTTTCAA AAAACCAGCT CCTGGATTCA TTAATTTTTT
579801 GAAGGGTTTT TTTGTGTCTC TATTTCTTTC AGTTCTGCTC TGATCTTAGT
579851 TATTTCTTGC CTTCTGCTAG CTTTTGAATT TGTTTGCTCT TGCTTTTCTA
579901 GTTCTTTTAA TTGTGATGTT AGGGTGTCAA TTTTAGATCT TTCCTGCTTT
579951 CTCTTGTGGG CATTTAGTGC TATAAATTTC CCTCAACACA CTGCTTTGAA
580001 TGTGTCCCAG AGATTCTGGT ATGTTGTGTC TTTGTTCTCG TTGGTTTCAA
580051 AGAACATCTT TATTTCTGCC TTCATTTCAT TATTTACCCA GTAGGTCATT
580101 CAGGAGCAGG TTGTTCAGTT TCCATGTAGT TTAGGGTTTT GAGTGAGTTT
580151 CTTAATCCTG AGCTCTAGTT TGATTGTACT GTGGTCTGAG AGACAGTTTG
580201 TTGTAATTTC TATTCTTTTA CATTTGCTGA GGAGTGCTTT ACTTCCAACT
580251 GTGTGGTCAA TTTTGGAATA GGTGTCGTGT GGTGCTGAAA AGAATGTATA
580301 CTCTGTTGAT TTGGGGTGGA GAGTTCTGTA GATGTCTATT AGGTCCACTT
580351 GGTGCAGAGC TGAGTTCAAT TCCTGGGTAT CCTTGCTAAC TTTCTGTCTC
580401 GTTTATCTGT CTAATGTTGA CAGTGGGGTG TTAAAGTCTC TCATTATTAT
580451 TGTGTGGGAG TCTAAGTCTC TTTGTAGGTC ACTAGGGACT TGCTTTATGA
580501 ATCTGGGTGC TCCTGTATTG GGTGCATATA TATTTAGGAT AGTTAGCTCT
580551 TCTTGCTGAA TTAATCCCTT TACCATTATG TAATGGCCTT CTTTTTCTCC
580601 TTTGATCTTT GTTGGTTTAA AGTCTGTTTT ATCAGAGACT AGGATTGCAA
580651 CCCCTGCCTT TTTTTGTTTT CCATTTGCTT GGTAGATCTT CCTCCATCCC
580701 TTTATTTTGA GCCTATGTGT GTCTCTGCAC ATAAGATGGG TTTCCTGAAT
580751 ACAGCACACT GATGGGTCTT GACTCTTTAT CCAATTTGCC AGTCTGTGCT
580801 TTTAATTGGA GCATTTAGCC CATTTACATT TAAAGTTAAT ATTGTTATGT
580851 GTGAATTTGA TCCTATCATT ATGATGTTAG CTGGTTATTT TGCTCATTAG
580901 TTGATGCAGT TTCTTCCTAG CCTTGATGGT CTTTACAATT TGGCATGTTT
580951 TTGCATTGGC TGGTACTGGT TGTTCCTTTC CATGTTTAGT GCTTCCTTCG
581001 GGAGCTCTTT TAGGGCAGGC CTGGTGGTGA CAAAATCTCT CAGCATTTGC
581051 TTGTCTGTAA AGGATTTTAT TTCTCCTTCA CTTATGAAGC TTAGTTTGGC
581101 TGGATATGAA ATTCTGGGTT GAAAATTCTT TTCTTTAAGA ATGTTGAATA
581151 TTGGTCCCCA CTCTCTTCTG GCTTGTAGAG TTTCTGCAGA GAGATCAGCT
581201 GTTAGTCTGA TGGGCTTCCC TTTGAGGGGT AACCCGACCT TTCTCTCTGG
581251 CTGCCCCTTAA CATTTTTTCC TTCATTTCAA CTTTGGTAAA TCTGACAATT
581301 ATGTGTCTTG GGGTTGCTCT TCTCGAAGAG TATCTTTGTG GAGTTCTCTG
581351 TATTTCCTGA ATTTGAATGT TGGCCTGCCT TGCTATATTT GGGAAGTTCT

FIGURE 3OOOOOO

581401 CCTGGATAAT ATCCTGCAGA GTGTTTTCCA ACTTGGTTCC ATTCTCCCCA
581451 TCACTTTCAG GTACACCAAT CAGACGTAGA TTTCGTCTTT TCACATAGTC
581501 CCATATTTCT TGGAAGCTTT GTTCATTTCT TTTTATTCTT TTTTCTCTAA
581551 ACTTCTCTTC TCACTTTATT TTGTTCATTT CCTCTTCCAT CACTGATACC
581601 CTTTCTTCCA GTTGATCACA GCGGCTACTG AAGCATCTGC ATTCGTCACG
581651 TAGCTCTCAT GCCTTGGTTT TCAGCTCCAT CAGGTCCTTT AAGGACTTCT
581701 CTGCATTGGT TATTCTAGTT ATCCATTCGT CTACTTTTTT TTCAAAGCTT
581751 TTAACTTCTT TGCCATTGGT TCGAATTTCA TCCTGTAGCT CGGAGTACTT
581801 TTATCGTCTG AAGCCTTCTT CTGTCAGCTC ATCAAAGTCA TTCTCCGTCC
581851 ATCTTTGTTC CATTGGTGGT GAGGAGCTGC ATTCCTCTGG AAGAGGAGAG
581901 GTGCTCTGCT TTTTAGAGTT TCCAGTTTTT CTGCTCTGTT GTTTTCCCAT
581951 CTTTGTGGTT TTATCTACCT TTGGTCTTTG ATGATGGTGA TGTACAGATG
582001 GGTTTTTGGT GTGGATGTCC TTTCTGTTTT TTAGTTTTCC TTCTAACAGA
582051 GAGGACCCTT AGATGCAGGT CTGTTGGAGT TTGCTAGAGG TCCACTCCAG
582101 ACCCTGTCTC CCTGGGTTTC AGCAGCGGTG GCTACCGAAC AGCAGATGTG
582151 GGTGAACCGC AAATGCTGCT GCCTGATTGT TCCTCTGAAA GTTTTGTCTC
582201 AGAGGAGTAC CCGGCTGTGT GAGGTGTCAG TCCGCCCATA CTGGGGGGTG
582251 CCTCCCAGTT AGGCTACTTG GGGGTCAGGG ACCCAGTTGA GGAGGCAGTC
582301 TGCCTGTTCT CAGATCTCAA GCTGCGTGCT GGGAGAACCA CTACTCTCTT
582351 CAAAGCTGTC AGAGAGGGAC ATTTAAGTCT GCAGAGGTTA CTGCTGTCTT
582401 TTTGTCTGTG CCCTGCCCCC AGAGGTGGAG CCTACAGAGG CAGGCAGGAC
582451 TCCTTGAGCT GTGGTGGGCT CCACCCAGTT CGAGCTTCCC AGCTGCTTTG
582501 TTTACCTAAT CAAACAACTA ACTCAGCAAT GGTGGCGCCC CTCCCCCAGC
582551 CTCACTGCCG CCTTGCAGCT GGATCTTAGA CTGCTGTGCT AGCAATGAGC
582601 GAGACTCTGT GGGCGTAGGA CCCTCCAAGC CATGTGTGGG ATATAATCTC
582651 CTGGTGTGCC ATTTTTTAAG CCCATTGGAA AAGCACAGTA TTAGGGTGGG
582701 AGTGACCCAA TTTTCCAGGT GCCGTTTGTC ACCCCTTTCT TTGACTAGGA
582751 AAGGGAATTC CCTGACCCCT TGTGCTTCCC GGGTGAGGTG ACGCCTCGCC
582801 CTGCTTTGGC TCATGCACGG TGCGCTGTAC CCACTGTCCT GCACCTACTG
582851 TCTGGCACTC CCCAGTGAGA TGAACCCGGT TCCTCAGTTG GAAATGCAAA
582901 ATCACCCGTC TTCTGTGTGG CTCACACTGG GAGCTGTAGA CCGGAGCTGT
582951 TCGTATTCGG CCATCTTGGC TCCTCCTGGG TGTGTCTTGT TTTCTAATGA
583001 TTAGATTATG GTTATGCATT TTTGGCAGTG GCATCACAGA AATTATACAC
583051 CGTTCTCAGT GCATTGTATC AGGGGGCACA TGATGCCCAC ATGCTTTATT
583101 CGTGAGGATG TTAGCATGGA GCACTTGATT AAGAGAGTAT CTTCTAGATT
583151 ACTACACTAT AAAGTTATTT TTCCCTTTTT GTAAAAAATA TATATTTTGG
583201 GGAGGGATAA TTTAGGCTTT GCAAATATCC TATTTCTTCT CAAACTTTTG
583251 TGCACTAATT TTATCATCCA TCCATAATTT TCTTTTGTAT TTGAATGTTG
583301 ATTTTCCTAT TTCTCTCTTG CCTTCTGTAT TTGTCAATTA GAATTCTTCT
583351 CTACAGAAGA GCTCTATTTC AGATTGTTCT ATACATAGAA TTATGCAATA
583401 TGTAGCCTTT GGATTTGGCT TCATTCTCTT AGCAGAATGC ATGTGAAATT
583451 CATCCATATT TTTTGTTGTT GTGTAATATT CCTTTGTACG CAAGCACCCT
583501 AGTTGGTTTT TGTATCCAGT GGTTGAAGGA CACCTGGGAT GTTTCCAGTT
583551 TGAGTGATTA TTGATAAAAC TTGTATAAAC AATCACATAC AGGTTTTTAT
583601 GTAAACATAT ACAATCATGC ACCCCATAAC TATTTTATGT CAATGGTGGA
583651 TTGCACATAC GAAGGTGAAG CCATCGGATT ATAATGGAGC TGGAAAACTC
583701 CTATCACCCA GTGACATCCT AGCCATCCTA ATATAGTGCA AAGTATTACT
583751 CACTTGTGGG TGATGATGCT GGCATAAACA AACATACTGC ACTGCTAGGC
583801 ATGTAAAAGT CTAGCATATA CAATTATACA CTGTACATAA TGCTTGATAA
583851 TAAATGACTA TGTTACTGGT TTGTGTATTA GCTAACTATA CATTTTATCA
583901 TTAATTTCAG AGTGTACTCC TATTTATTAA AAAATGTTTA CTATAAAACA
583951 CTATGTGGTT TATGCCAGCA GCAGCCTCAG GCATCATGTG TTTACTGCCT
584001 CTTGTTTACA TCGTATTCTC TTGTGCTTGA TTTAATCTTG TGTGGTTTTG
584051 TGGCCCCTAA ATGTGCAAAA TCCACTGCTA ATGTTGCCAG GAAGAGGCTA
584101 CATTAAGTGA TTGACTTGCA AACACTAAAG GTGATTAAAG ATGAGAAAAT
584151 TGGAAAATCA CTGATAATTG TTGCTCACCA GTCAGGCATG TCCCATTCCA
584201 CCATAGCTAT GATCTTGAAG AATAAGAACA AAATGTCAGA ATCTGTTAAA
584251 GGATCTGCTT CATTGGAGGC AGCAAGACTA ACAAAACTTG AAGAAGGGCC
584301 TATATCAGAT GTGAAGAAAC CTCGAATGAC TCTGGATTGA ACACCAGACA
584351 CAGAAATGTA GCTCTCTCAG AACCCTGATC ATCTTGGCCA AAGCAAAAAG
584401 TTTGTTTACA ATGTTGAAAT AAAAGGCTGG TGGGCATTGT GGCACACACC
584451 TGTAGTCCCA GCTACTCAGG AGGCTGAGGC AGGAGAAAAA CTGGAACTCA
584501 GGAGGCAGAG GTAGCAGTGA GCCGAGCATC ATGCTACTGC ACTCCAGCCT
584551 GGGCGACAAG GCGAGACTCT GTCTCCAAAA TAATAAAATA AAATAAAATA
584601 AAATAAATAA AATAAAATAA AAGTCTGGAC CCATCTATGT TGAATTTCCT
584651 GCTAGCTCTG GGGGCTTAAA AATTCAATAA TCATTATTCA TTACATATGT
584701 GAAAATGAGA GTGAGTGGTG AGTCTGTGAG TGTTCATGTA AAAGCAGCTG
584751 AAGAATTTTT GAAAACTCTA GATAAGCTGA TTGTGAAGGA AAATTATTTG

FIGURE 3PPPPPPP

584801 CCAAAGCAAA TCTCCAGTAT GGATGAAACC TCCCTATTCT GGAAACAGAT
584851 ACCAGAAAGG ACTTTCATCT GTAGGAGGCC AAGTCAATTC CAGGTTTCAA
584901 GGCTTTTAAT GACAGGATAA CAGTCTTGCT TGGGGGAAAT GTTGCAGGCT
584951 AAAAATCAAA ACATTTTATG ATCTCTCACA GTAAGAACCC TAAAGTCTTG
585001 AGCATATCAG TAAGCACAGA CATCCATTTT ACTGCAGGGA CAATAAGAAT
585051 ATGTGGATGA CCCAGTCCCT CTTCCAAGAT GCCCTCTTGA ATTGCTATGC
585101 CAGCAAAATG GAGAAATGCT GTGTGGAAAT AATGTATCTT TCAAGATGTT
585151 GCTTATTGTT GATAATGCTC CCACACATCC TTTTTTTTAT TTGTGATCTT
585201 CATCCCCATA TTAAAGTGGT GTCTCTTCGT CCAAACACCA AATCTTTAAC
585251 CCAACTAATG AATCAAGGAG TTAATAGCTT TTAAGGCCTA TGACCTGAGA
585301 AGGATCTTTG TTCAGGCTAT TGCAGCAACC AAGGAAAACA CTGGGAAGAC
585351 ACTGATGCAA TTCTGCAAGA ATTAAAACAT CTCTGACTGC ATCGAGAGCC
585401 TTGCTTGGGC TTGGAATGAT GTCACCAAGA AGTATATGAA TGGTACCAGG
585451 AAGAATACAT TCAAGAAATA GAGGGGGAAA TCCTGTGTGA TATTAAGATG
585501 GGGGTATATT AAGATGGTGA GACCATGATC TGTTGAGGAC CTACTTTATT
585551 TTATTTATCT TGGTCCCTAC CATATTGCTA AACACACATT AAGCAGTAAG
585601 TACATATAGA TGAAGGAAAA TGTCAATAAA AGACAAAAAG GAAGGAAAGG
585651 AGAGGAAAAG AGTGAAAAGA AAGGAAAGAA ATGAGAAAGG AAAGGAAAGA
585701 AGGAACCTAA TTTTTCAAGG ACTTCAAGCT CAATTCTAAA TTTTAACACT
585751 TTCTAATGTC AGTCACATTT ATATAAAATT AGAAGCTCTT CTCATAATTG
585801 TGCTTCTCTA TACTTTTGCA ATTTCTCCTA CCTTTGTGCA GCAATCATAT
585851 TTTAGCTGTG TTTCTCCTCT GAACTTTTAA CTCTCTATAT TATAATTATT
585901 TAGGTACATG CCTTTCTACA TAGACCAGAA TCAACTTGAA AGTAAGACCA
585951 CAGCAAATTC ATCTTTATAT TCCCCCACAT TATCTAGTCT GTATCTTGTA
586001 TTTTATGGCA TTCAATCCTA GTTGTGAAAT GAATACAGAA ATAGAGCACA
586051 GTCTTCTGTT TTCTGGGCCT GAGAAGTAAA AGTAGGCACA CCTTAGTCCA
586101 CTTGTGATTG AGATAAAGCA ACAGAATGAT GTAAATTCAT TGACATTTTC
586151 ATTGGGTTAT ATCAATCACT GTTGGTATAT TTATTCATTT TTCTCTCATC
586201 ACAATTGTCA AACAAAGACA TCAGTGATTT TTTTTCTCCT TTCATTTACA
586251 TGCAATTGCT GTTTTGGGAT TCTTAGCCCT GAAAATAATG TGTTGACCTT
586301 TCTCCTGCAC ATTAACAAGC ATGATTCTTT TGAAATAGGT TTAGTTTTTA
586351 TTCTAGCATA GCCATATATT ATATATAACA TGCTGTTGTG TTTAGTATGG
586401 CTCTCCATAA ATACAACGAG CTATAGCACC TCTGTGACTT TGTCACTATT
586451 TTATATACCT AATGGCTGAA CTATTCCATT ACACTGAAAT GATAGTACAC
586501 AAACATGTCT TCCATTAGCT ACAGTTTCTG TGATTTAATG ATTTATTTAA
586551 TATAGAGTAT ATCTCATTGC AAGAAATTCC AGGACATTCT CTGGGGAATA
586601 CAAGTCTGGA AAGGAAATAC AAAGCTACTG GAGGGACTTG AGCAAAGAAA
586651 AAGGCTGCTT AAAGAGAATA AGAATCAAGA GAGAATATAC TGAGATTTCT
586701 TAGCTTGTTC CCCAAATGGA GAAACTAGTT ATTTCCCTAA AAGAGGATAT
586751 ATAATTAATA TAATTACTTC TTATATGTCA GCTAAATAAA GTTGCTAAAA
586801 CAAAAACAAA AGCTTTCCTC ATGTTAACTG TAATGTTTCA AATTATTCTT
586851 CTTAAATGAA ACAATGTTCC TAGGTCATAG AGTTGATTGC TAACAGACTC
586901 AGAAAATATT TCACACAAGC TACCTCCACG CAGAAAATGT GGAAGACTGT
586951 GTTTATCAAA TGATGAAAGT TTTAATTACA TAACATGTAA ATGTACTATT
587001 TTTATAAGAT AAAACAAAAT AATGCTACTG GTTCTTTGGT GTAGTCTCCA
587051 TATCTTTGCT ACAGAAAAAA TCTTAATTGC TAAGGAGGCC CAGCCTTCAG
587101 TCTAATTACA GGCATCTACT TCTTTTCCTA ATTAAGAAAT TGAGAACTAG
587151 CCAAGAAAGC AGAAAGGAAA CACAGGTTGG CAGGGAAGTT GGCCTGAAGG
587201 GAGAAAACCT CTTGCTAAAT CAAGTTTGAA TCCCATCAAT GACTTAGAAA
587251 GAATCTAGTT CCAAATATAA TGGAATGAGG AGTGTATTTT GTATGTGTTA
587301 AAGATATCTC TCTTAAAATA GGCAACATCT CTCTTTTAAA AAAGGACATA
587351 TTATCCAGGG ACATTATGAG AAAAGTCATG CTGCAGTTTA GAACCTTGAT
587401 AAGCCAATCA TGGAAAAACA AAACAAACCT ACTTCAAATG GTAACCTCAG
587451 TGGTTAGCAT TAAAGAAAGG AATTGCAGTA AATACTAGTT TTGTAATTTC
587501 CAAATTTTGT CCATAAAGCA CCTCTTCAAT GACACAGAAA TAATAAAATA
587551 CAAATATCTA GTTTTAAATT GTGTATACTC TGATTTTGTA AAGTAATAAC
587601 TTATTAGTTT TTGAAAATGT TTCATAACAA TATTTTTCTT CTCTGAATTG
587651 AGCCTTGTCT TACAAAACAT TGCTCATAAT GGTCAGATTA GATACAATTA
587701 CATGAACTGA TTAGAGAACA TATTAATGTC TACTTTGTGA TTCACTAGTG
587751 TCTTGGATTA AAGAAATATT TCCTAGACAA ATGCAACTAC CTCATAATTG
587801 CTCATCCTGC CTTCAGTCTT GCCCCTACCA CAACCCATTC TTCACTTTTG
587851 CAGCCGGATT AATCTTTATA CAAAAAGTTT TGCAAAATTC TTAGGAAAAA
587901 CAACAACAAA AATCCAGTCT TCACTTTGGC ATATGAGATG ATCTGTATCC
587951 TGCTTACCTT TCAGATGTGA TCTCCCCTTC ACCCCTGCTA ATCCACAATG
588001 CCCCAGACCA GCTTTGTGCC TTCTACAAGC CAATCTCTCT GTTGCTTTGG
588051 GGCTTTCCTG TGTTCTTGTT GATTGCCCTG ACCTTCCCTC ATGTCCTCAC
588101 AAGGCTGTCT TTCAAAAACC TACCTAAATC TAAAGTAGCC CTCCCCAACC
588151 CCAGATACTA CTTATTTTAT ATGTTTTGGA TAATTTATGA AGAAAAGAGA

FIGURE 3QQQQQQ

588201 TTTAATTGAC TCACAGTTCT GCATCACTGG GGAGGGCTCA GGAAACTTAC
588251 AACCATGGCA GAAGGCTAAG AGTAAGCAAG GCACATCTTA CATGGCTGCA
588301 GGAGAGAGAG AGAGAGAGTG AGGAAGTGCC ACACTTTAAA ACCATCAGCT
588351 CTCATGAGAA CGCTTCACTA TCAAGAGAAC AGCATGGGGG AAACCGCCCC
588401 CGTGATCCAA TCACCTCCCA TCAGGTTCCT CCCTCAACAT GTGGGGATTA
588451 CAATTTAAGA TGAGATTTGG GTGGGGACAT AGAGTCAAAC CATATCACAT
588501 TGTATCCTGA TGGATGGGAT ACTCTGGTCA GGATGTCACA TTGCTCTCCC
588551 TAAGGAAGGA GAGACTGACA AGACTAGCTT GGAATCATCA TGTGGCATTT
588601 CCCAAAAGGA AGGTAATTGA TGTCTACTGT ATGGCTTTCA TAAAAATCTC
588651 TAGAAACATA ATTTCTTTGG TTTTGATACT TATAACTATT TCTGTGTTTG
588701 TATGCATCAT CTATATATAA CAATAATATA AACTATCAGC CTTGTTTATG
588751 ATTCATGAAA TAACTAAGAG GATGGGAAAA AGTCAAATAT TTTATGAAAG
588801 AAAGTACATT ATTAACAGCA ACAACTTAGT GTAGCCATGG TTGTGTTGTT
588851 CATTAACTGC AATTTAGTTC TTTTTCAATA GTTGCTTATA AATGGGGCTA
588901 TGAAAATGAA TGGATTTTTT TTTCTTTTTC TTAACTTCTA TTTGAACAAA
588951 ACAAAAAGTA TAAGAAGTGA AAATACATCA TAAACCTGCT GTTAAAATTA
589001 TTATTAAAGG TAAAATCTGA TTATCCTTCT GCCATCCAGT TGTATTCTCT
589051 AGAGCTAACC CTTGTTAATA ATTCAGAGAT GGACTTCCTA AATTTTCCAT
589101 AAAGGTTTGT AGACACATTT ATATCTACAC TTATATATTG TTTTATGAAC
589151 AAAAATGGAA TCATGCTATG CAAGTTAGTT GCAATTTTTT TTAATTTAAC
589201 AGCTATTTCT TTTAGGTTTG ACTATGAGTA ACTGAACAAC TAGAATCCTG
589251 GCTTAAAATA AGAAAGAAAC TTGTTTCTTG CTCACATAAA AGTCTAAATG
589301 GCAATACAAA GCTTTTTGGT GGGTCCATAA TCAGGGGGTG GCCAGGTTCC
589351 TTCTATGTCA TTTTTCCACT CTTTTCAACA TAGAACTTCA AACTCATAGT
589401 CCAACATGTT GTCATAGTTC CATCTATCCC GTCCGCCCAA CCTCCAGCCT
589451 CAGGAGGTAG AACACTGCTT GCAGGTTACA TTAAGAACAG TTCCTTGTGT
589501 CTGTACTTGA GAACAGACAC AAGGGAGGCT GGGAAATGTA GTCTGTATCA
589551 TGGTGGTCAT GTTTTCTGTT TCTTGCCTTT TTGTATGTTC TGATGTTTTG
589601 ACATCTAAGA CTTGCTAAAC TTGGAGTGAC TGCCCCTACC AGGGCTGCCC
589651 AATTCCAGAG ATAACAAAGG GCTCACCTGT GAGTGTGCCT TTTTTTTTTT
589701 AATTATTATT ATACCTTAAG TTTTAGGTTA CATGTGTACA ATGTGCTGGT
589751 TGGTTACATA TGTATACATG TGCCATGCTG GTGTGCTGCA CCCATTAACT
589801 CGTCATTTAG CATTAGGTAT ATCTCCTAAT GGAATCCCTC CCCCTTCCCC
589851 CCACCCCACA ACAGTCCCCA GAGTGTGATG TTCCCCTTCC TGTGTCCATG
589901 TGCTCTCATT GTTCAATTCC CATCTATGAG TGAGAACATG CGGTGTTTGG
589951 TTTTTTGTCC TTGTGATACT TTACTGAGAA TGATGATTTC CAATTTCATC
590001 CATGTCCCTA CAAAGGACAT GAACTCATCA TTTTTATGGC TGCATAGTAT
590051 TCCATGGTGT ATATGTGCCA CATTTTCTTA ATCCAGTCTA TCATTGTTGG
590101 ACATTTGGGT TGGTTCTAAG TCTTTGCTAT TGTGAATAGT GCCGCAATAA
590151 ACATACGTGT GCATGTGTCT TTATAGCAGC ATGATTTATA GTCCTTTGGG
590201 TATATACCTA GTAATGGGAT AGCTGGGTCA AATGGTATTT CTAGTTCTAG
590251 ATCCCTGAGG AATCGCCACA CTGACTTCCA CAATGGTTGA ACTAGTTTAC
590301 AGTCCCAACA GTGTAAAAGT GTTCTTATTT CTCCACATCC TCTCCAGCAC
590351 CTGTTGTTTC CTGACTTTTT AATGATTGCC ATTCTAACTG GTGTGAGATT
590401 GTATCTCATT GTGGTTTTGA TTTGCATTTC TCTGATGGCC AGTGATGGTG
590451 AGCATTTTTT CATGTGTTTT TTGGCTGCAT AAGTGTCTTC TTTTGAGAAG
590501 TGTCTGTTCA TATCCTTCAC CCACTTTTTG ATGGGGTTGT TTGTTTTTTT
590551 CTTGTAAATT TGTTTGGGTT CATTGTAGAT TCTGGATATT AGCCCTTTGT
590601 CAGACGAGTA GGTTGCGAAA ATTTTCTCCC ATTTTGTAGG TTGCCTGTTC
590651 ACTCTGATGG TAGTTTCTTT TGCTGTGCAG AAGCTCTTTA GTTTAATTAA
590701 ATCGAGTGTG CCTTTCATAT GCAAACCACC CACGCCAAAG CTCATAGGTC
590751 CCAAACCACC TCCTTTACTG AGCTCTAATA CACCAAGCTA ATATTACCCT
590801 GTCCTAATCA CCCCAGGTAT AGGAAAACTA GGGCCAGCCC CTACATTCTG
590851 AAGCCCACTG AAATTATTCA AATTATCCAA CCTTAAACCT ACTTAGCCTG
590901 CTTACACCCT GCTTCACCCA TTCCTTCCTG AAAAAACCAC AAGAGAGGAT
590951 TTTGTCCAAG TTTTCCCCAC ACTCTCTGCC TTCTGATCAA TCCTGGTGCT
591001 TCCTCGTGTG ACCCTTTTGT TTCTAAAGAT CTGTGAATAT GAAAACTTCC
591051 TTCATGACTG TCATTTTCAA GTATGTATGT GCATTAGTCT ATTACCATGC
591101 TGCTAATAAA TACATACCTG AGACTGGGTA ATTTACATAG GAAAGAGGTT
591151 TAATTCACAG CTCAGCATGG CTGGGGGGTC CTCAGGAAAC TTACAGTCAT
591201 GACAGGAAGG GGAAGCAAGC ATGTCCTTCT TCACATGGCA CAGCAAGGAG
591251 AAGTGCAGAG TGAAGCAGTA TGGAAAAGCC CATTATAAAA CCATCAGATC
591301 TTTTAAGAAC TCACTCACTA TCTTGAGAAC AGCATGAGGG TAACTGCCTC
591351 CATGATTCAA TTACCTCCAC CAGGTCCCTC CCAGGACACA TGGGGATTAT
591401 GGGAACTACA ATTCAAGATG AGATTTGGGT GGGGACAGAG CCAAACAATA
591451 TCAGTGTGTC TTACTATACA GGTTCAAAGC AAATCCTGAG TGCATTTTAA
591501 AACATTACTA GGTAGTGATC ATTGCACAAC TTTGTAAATC TACTAAAAAT
591551 CACAGAACTG AAAATCCTTT AAAACAGTGG AAGTTTATGG TGTGTGAATT

FIGURE 3RRRRRRR

591601 TATATCTCAA TTAAAATTTT TAAATAAAAC GATTATTTCT CTTAAAGTAT
591651 AAAAATTAAA TAATGGATAT TATGGGGTGA TAACCTCTGC TAAAACTGTG
591701 TTATTTTCCA GATTAGTATA GTACATACAA ATATTTCTCT TTTATTTTTG
591751 TGTCTGCCCT CTATTATATG AGTGTATTCT CTTTTACTTA ACCTTTCAAT
591801 CTATTGAAAC TATGCTATAA TTTATATCCA GGTCATACTT TTATTATCAT
591851 AGGATAGATT CATAGAAGTG TAATTCATGA GTCAAAGAAT TTGACATCAG
591901 TTTGTGATTT CACATCACAA AGGTCATGTG ATTTTTTTTA AATACTGAAA
591951 ATTACTTTCC AAAGTGTTGT AGCAATTTAG AATTCTTCTG AACGAATAAG
592001 AGTGCCCATT GATTTTACTT AGCTGTATCT GCTGGGTATC ATTTTAATAT
592051 TTTCCAATAC AATTATTTGT AAAAGCACCT GATTATTGTT TTAATTTTTA
592101 TAACTTGACT ATGTGAGATG CCTGGCATTA TTTTATATGT TCATTAGCCA
592151 TTTTCATCTC TTTTTCTGAC AATTGCCTGC TTGTGTCCCT AGCTCTTTAT
592201 TGGCCTGGGA TATAGAACCT ATTATTAACC AGGGACATTA ATATTACCCT
592251 ACCATCTCTA TCTGGAAATG TATAAGATGG TCTCTTTTAT CTTATATGTT
592301 CCCGATATAT GTCTAAGAAT ATGTCTTTTT AATATTAATT CTGACCAGCT
592351 TGCCATGTAT CCCTGAGAAT AGAAAACTCA CTTTTTCTCC ACTTCAGGGT
592401 AGTTTTCTTC AGTTATTTCT TTGAACATTA CTCCTCCTCA TTTTTATTTC
592451 TCTCCTGCCG AAACTCAGAG TGTGCATGCT AGATATGCTG AATCTATCCC
592501 CTTTATATTT CATACCTTCA CACAGGAGTT TCCATTCTCC TGTGATTTTA
592551 AGATAGCTTG TGCATATGTT TTAAAATGAG CATTGAGTTT TAAAAAATTT
592601 TCTTTAGGAT GTTTTCCTTT TTCTTTCTTA ATATCTCATT ATAATCCCTT
592651 AAGAATTCTC ATCACACATT TTTCATGACT CATCTATTCT TTAGCTATAT
592701 TTGCTTTCAA GGAGCCACCT GCTCTGGTGG TTCAGCTCAG TCTCCTTTGA
592751 TCAACTCCAC TTAACTTTTC TTTGTAGACA CAAGATGGAG GGTTCCCTAA
592801 GCACAGGGGC AGGACAAGTA AAGTAGATCC GGCAATCAAT ATAAATAAGA
592851 TTAATAAATC TAACATATTA ATAAGATTTT CTTTTCTAGT GTTGAACCTT
592901 TCTACTGAAA CATAGGCATG GGTAGAGGAA GACAGGCCAT TTGATTCCTA
592951 GGTTCTGCAC ATGTGAGGTG GATGGAAGAT CCTTTTCCAG CTGAAGGCAT
593001 ATTTGTCTGT AGCAGAAATG TCAGGCTTTC CCATATCCAC AGGCATCTAG
593051 CTGAAACAGA ACTTCCCCTC TTGTGATATG GTCATATACT CAGCTACTGG
593101 GCTTCCAAAG ACAGTCTCAG GATTGACAGT TTTCATCTCA GTTTCTACCT
593151 AAAGAGTCAA CCTTCTACCA GGCCCCTAGC TACTTTCCAT TCAGTCAATG
593201 AGTAAATCTT CTGAGACATT ATTTACTGTT TTCCCTTCAT GGTTATTTCC
593251 TATCTCTCCC AATGCTATGA GTGTTTTGTC TTTCCCCCTT TCCCCCATTC
593301 TCTATACTTT CTGCTACACC TCCACCTTCT ACATATATAA TTGTCTCTAT
593351 GCATGCATAC ACATGTATAA GGAAATATTA ATGTGTTTCA GAAAATAAAA
593401 TAGAAGTAAA GCAATACTTG AAAAGTGTGT GATAAAATAT GTCCAGGCCT
593451 TTAAACTCAA GTGCTTTTAG GAAGCAGTAC AAGGTGTCAA TATATATGGA
593501 CAATCTGCAT GTAATATTTG ATATATGTTA AATAAAAATA AGTGTCATGG
593551 TCCACTGTAT CCCTGGACTT ACAAAGAAAA TCCAGAGTTA GAACATGAAT
593601 GTCTTTGTTA TATTGAACAT TTCTACACAT ACTAATGATA AGCCAAAATA
593651 TATTATTTAT ACACTTTAAA ACATTTGTTT TACAGAATTA AAATAGTGCT
593701 TATTGATAAC TTATATAAAT TGCCAGTAAA GTAACCAATA TGTGTGAGAC
593751 ATGCATGCAG TTAAGAACAA AATATGTGTC ATCATTTAAA AAATATTGGA
593801 AATAACAATT TATTTTCAAT GAGTGCATAG CATGCATAAA GATGAATAAG
593851 AAACTTTGAG GACTTCAGAG TAAGTAGTAT AATGATGACA AAAGGAACTT
593901 TTCCAAAACA GGTAGAATTA AAACAAACTG CTAGTATTAC CAATTTTCAC
593951 AATACACATA ACCAGCATTA CAAACTATAC ATAACCATTA ATAAGGGCAA
594001 GACAAAAACT TACCTCACTC CCATAATTCT ACTGAAATCA TAGTGGCAGT
594051 GCACAAAATG CAATGCATAT GAATTGGCAT TGATAATAAC AGGAGAGAAC
594101 TCTAGAGATT TTGGTGAATA TGTGCAAATA GAAAGTGAAT TGTTTTGAAT
594151 GGGTTGATGA ACCAGAAAGG CAGGACATAC AGCTCAAAAA ATCCACAAGA
594201 AAAACAGTTG GGAGCCACTC TTCTAGAAAC AAAGAAATTC TGAATCAGCA
594251 GACAGAATGG AACTAAGAAG GCACAAAGAA ATCAGAGTGA CTGAGTGGAG
594301 GAATTTCTAC CAAACCTGTG TTGCCTACCC TACTCACTTC TTTCTCATAT
594351 TTCAGAGCCA CTGGAAATGA TGACATATAT CCTCAGGGCA AAAGGGGAAG
594401 CAGGCTTTCT AAAGAAGTAA ATCAAGGTAC CTGAAAAGCA ATAGAGCTAA
594451 TGTGTATGCT GTCACACAAG AGTGAAGCTT CCTTATTTTT TGCATGGATA
594501 GACTTGCTTG TGCAAATCCA TTAATGCACC CTAAAGTTAA AACTGCCAGC
594551 CAACAGCCCT TAGTCAGCTA TCTCATTAAG GGATGCAGCT CTAGAGATGG
594601 TGAAGAGACA ATAAAGTTTA CCATATTTTG ATTAAAAGGC CACAAAAGAG
594651 AAGTAACAAG GAGTAAAAAC AAAACTAATC ACCATAAAAT TTATTCAGAA
594701 AATGTAAGAA AACCCCTTTA AAAAATTCTA TTTGATGTTC TCAAAGAGAG
594751 GGGGAAAGAT ACTGCATCCA TAAAATAAGA ACAGGTTGCC ATTAAAAAGA
594801 AAAAAAAGAA AAAAATCCCA GCCAAACTAT CTAGAGTGAG AGTCAAAAAA
594851 TAAAAACCAA AGAAGAACTG TTTAAACATG TGCAGGAATA AGAAACTCTG
594901 TTTTCCTGAA ATCATGATTG AAATAAAAAA AAAAGAATCC ATGGAATAGA
594951 AAGTTGTGGA TTTTCAGAAA AGTGATATAT AAGCACAAAG AAAAGAAATT

FIGURE 3SSSSSSS

595001 CCAGGAGAAT AATCATGCAA AGTGCCCTGA GAACGATTGA TTTAAATCAG
595051 AAATATAGTC TTAGGCCTTC ACAAGAGTGT ATTTAAATAT AAGAACAGTA
595101 TGGGTTTTGT TCAACAGATA GTGTGATTGT GAAACTAGAG CATCTAAAGG
595151 TAGCTACTAG GTACATGTGC TTACTGAGAT TTAAATTGAA ATTAATGAAA
595201 CTTAAATACA ATTTATAATT TGGTTCCTCA GGCACACTAG CCACATTTCC
595251 AGTGCTCAAT AGCCACATAT GGCTGGTGGC TACTGTATTG GACAACACAA
595301 ACATAGAATA TTTTCATCAT TGCTGAAAAT TGGAGTGAAC AGCTTTGATC
595351 TTGGTGATAT GGTGAGCTTA TTGCTTTCAT TCATTCTTCA AAGAATATTC
595401 ATTGAGTAGA TTCATTTTGA AGAAAAGGAC AAACTGAGAA TATAGCATCT
595451 ATAATGAGTG AGTAAAGGCC TTGTCCTTCT ATGGACGTAG CATCTAAGAG
595501 AAAGACAATA AACAAATACA GGGATACTCA TTTTTATTGC ATGCTTCTTT
595551 ACTGCTCTTC ACAGGTATTG CGTTTTTTAC AAACTGAAGG TTTTTGGCAA
595601 CATTGCATTG AGCAAATCTA TCAGTGTCAT TTTTTCAACA GTATGCACTT
595651 ACTTCATATC TCTGTGTCAC ATTTTGGTAA TTCTGGCAAT ATTTAATTTT
595701 TTATTATTAT TACATTTTGA TATTGATCTG TGATTGATGA TCTCTGATGT
595751 TACTATTATA ACAGTTTTGG GATGCCATGA ACAATGCCCA TGTAAGATGG
595801 TAAACTTAAT TGATCAATGT TGTGTGTTTT CTGACTGTTC CACCAATCAG
595851 CCATTCCTCC ATTTCTCTCT CCTCAGGTCT CACTATTCCC TAAGGCACAA
595901 TAAGATTGAA GTTAGGCCAA TTAATAACCT TACAATGGTC TCTAAGTGTT
595951 CAAATGAAAG GAAGAGTCGC ATATCTCTGG CGTTTAAATC AAAGCTAGAA
596001 ATGATTTAGC TCATAAAACT CAGTGAGGAA AGCGTGTAAA AAGCTGAGAT
596051 TGACTGTAAA CTAAGCCTCT TGTGCCAAAC AGCCCAGTTG TAAATGCAAA
596101 GGGAGTATTT TGAAGAAAAA TAAAAGTGCT ACTCCATTGA ACTCTACAAT
596151 GAGAAGAAAG TGAAGCAGCC TTATTACTGA TAGGGATAAA GTTTTAGTGG
596201 TCTGGATAGA TCAAACCACA ACATTCCCTT AAGCCAAAGT CTGATGGAGA
596251 GCAAGGCCCT CTCTTCAATT CTATGAGGGC TGAGAGAGTT GAAGAAACTG
596301 CAGTCAAAAA TTTTAAAGCT ACCAGAGATT GCTTTATGAA GTTTAAAGAA
596351 TGAAACCATC TCTGTAACAT AAAAGTGCAA GGCAAAGCAG CAAGTGTTGA
596401 TATAGAACTG TTGCAAGTTA TCCAGAAGAT CTAGCTAGGA TAATTGATGA
596451 AGGTAGCTAA ACTAAACAAC ACATTTTCAA TGTAGTTGGA ACATACTTCT
596501 ATTGGAAGAA GATTCTTCTA GAAATTTCAT AAGTAGAGAG AAGTTAGTGT
596551 CTGGCTTCAA ACCTTCCAAG GACAAGCTGA CTTTTCTGTA GGGGCTAATG
596601 CAGCTGGTGA CTTTAAAAGG AAGCCAATTC TCATTTACCA TTCTGAAAAT
596651 CCTAGGGCCC TTGAGAATTA TGCTAAATCT ACTTTGCCTT TGCTCTTTAA
596701 ATGAAGCAAC AAAGCTTGCA TGACAGCACA TCTGTTTATA GCCTGGTTTA
596751 CTAAATATTT TGAGGCTACT ATTGAGACCT ACTGGTCAGA AAAAAAGATT
596801 CTTTTCAAAA TAATACTGCT CATTGACAAT GCACTTAGTC ACCCAAGAGC
596851 TCTGATGGAG ACATACAAGG AGATTAATGT TATTTTCGTG CCTGCTTAGA
596901 AAACATCCAT TCTGCAGCCC ATAGATCAAG AAGGAAGTTT TGACTTTCAA
596951 TGTTATTATT TCGGAAAACT ACATTTCATA AAGCTATAGC TGCCTTAGGT
597001 AGTAATTTCT CTGATGGATC TGGATAAAGT AAATTGAAAA TCTTCTGGAA
597051 ATGACTCACT ATTTTTAGAT GCCATTAGGA ACATCTGTAT TTCATGGGAG
597101 GAGGTCAAAA TTTCAATGTT AACAGGAGTT TGGAAGAAGT TAATTCCAGC
597151 TCTCATGGAT GCTTTTGAGG GGTTCAAGAC TTCAGTGGAA AAAGTAACTG
597201 CAGATGTGGT GGAAGTCGCA GGAGAACTAG AATTAGAAGT GGAGCCTGAA
597251 GATGGGGCTG AATTATTGTA ATCTCATGAT AGAACTTTAA TGGACAAGGA
597301 GTTACTTCTA TGGATGAGCA AAGAAAGTGG TTTCTTGAGG ATGAAATCTA
597351 CTCCTAGTGA AGATGCTACG CACATTGTTG ACAGTGCAAC AAACATCAAC
597401 TTAGTTGTTA ACACAGTGGC AGAGTTTGAG AGGAATGACT CCCGTTTTGA
597451 AAGAAGTTCT TGTTGCTGTG GGTAAAATGC TGTCAAACAG CATTGATGGT
597501 TCAAAGAAAT CTGTCATGAA AGGAAGAGTC AATCAGTGTG GCTAGCTTTA
597551 TTGTTGTCTT ATTTTCAGAA ATTGCCACAG CCACCCCAAC GTTCGGATAC
597601 ATCAGCAGCC ATCAACATCA AGGCAACACC CTCCACCAGT AAAAAGATTA
597651 CTACTTGCTG AGGGCTCATA TGATCATTAG CAGTTTTTAG CAATAAAGTG
597701 TTTTTAATTA AACCAAATAC AAAATATGTA TTTTGTATTT TTAGGCATAA
597751 TGCTGTTGCA CACTTAATAA ACTACAGTAT ATTGCAAGCA TAACTTTTAT
597801 ATGCACTTGG AAACCAAAAA AAATTCATTC GACTTGCTTT ATTGCAATAT
597851 TTACTTTTATT GCAGTGGTCT GAAACCAAAC CCACAGTATC TCTGAGGTAT
597901 TCTTGTAATG CGTAATATAA TATAATGGAT TGACAGCTGC CAAAAGGAAA
597951 AACAAAGAAG TATAAAGTTA TGTTGAAGGT GAGGGCTGGA GACTATTTGA
598001 AGTCGGATGT GAGGAAAGGC TTATTGGAGA ATTTGATGTT GGAGGGACGT
598051 AGAATGTCCT GTGAAAATCT GTGGGAAGTA TACTCCATGT AAACAGAAAG
598101 TCAAGTAAAA ACATCCCTGA GGTGGAAAAA TGTTGAATGT CCCACAGAAC
598151 TTCAAGAAGG CTACTGTGGC TGAAACAGCC AATAAGGAGC ATTGCAGAAG
598201 ATAAGGTCAG AGACGTAAAC AGGAGGTAGA TCTCATAGGG ACATATCAGC
598251 AAGAGTTAGG ATGTAAAATT TTATCCCAGG GGTGATGGGA AATTTTTGAA
598301 TGGAGAGTGA CATTATCAGA TGTATACGTT CAAACCATCA CTTTAGCAGT
598351 TTTTGTGGCA AATTAATCTT AGGAGTGCAA GAGCAAAGTA AAATTTATCT

FIGURE 3TTTTTTT

598401 TTAAAAGCTT TAGAAAAGGT AAATATATTT ACCAGAAAGT TCCTGGTCCC
598451 AATATGAAAC AAACTGAAAC TTACAGTGAA TGGAGTATAA GAATTAAGCA
598501 TTATTTAACC TTGAGGTCCA AAACATTCTC CTTTAATGGA CATGTTTAGA
598551 GATAGACTTG TACTTCCTTC TCTACAAATT AATTATAATA ATGTTTTTCA
598601 ACAAATAATG TTTATTTAAG CCAACTATTA CAAATTCTGT TTATTAGTAT
598651 CAAGTGTTTA GAATCACACT GTAAGCAAAG AATGAAACAA AATCAACTTA
598701 ATAGTTACAA ATATGAGTTT ATACACATTT AAAAGTAATT ACATAGCTGA
598751 TAATTCAGAA GATGGAGGCT AATAAAGGGA CATGAAATGT TTTCATCTCA
598801 CATAGTGAAA TGTTGATGGA GCAATTAATA GAAGTGTGAA TATGAAAAGC
598851 GTTAAGTTAA TTAGGGGGAA AACTAAAAAT AATTAATAAA ACTAATAAGA
598901 CTCAGGAAGA AGTCAGTAAC TTAATAGGGA GTCATTTGAT TCTATCTAAA
598951 TCTGATAAAT TAAGAAATAC TTGTAAAAAC ATTATTTATT ATTATAATAA
599001 TTCTCACAAG CACAAATCAT AAGTGTACAA AAAAAGTTTA CCTTTAAGGA
599051 GCAAGAAGTT TGCATGGGCT GGTAGACCTT TTCATTGTTG TTTAATACCA
599101 TTCTGAAGTA TTGCATTTAC AAGTATGTGC TTGCCATATT TTATAATAGT
599151 CATAATAATT CTGTTATGTA AAACTTGTAA ACAGAAAATA TGTTGTATTG
599201 TTGATATCCT ATTGTAAACA TTACACTTAT TTTTTTCTCA CAATCAAATT
599251 TAAATTGATT GACAAAATAC ACATTTTAGA TGCTAAATTA AAGGGTCAAC
599301 TTTATTAAGG GTCGACTTTT AAAGAAACAA CAAATAACCA AAATTTAGAA
599351 ATCACAGAGT ATTAAAAACC ATGACAGATC ATGACACAAA TTGCCATCCA
599401 ACATTTTTTT TTCCTAAAAG GTAAACAACA TATACAAATG GATTGTATAC
599451 ATGGGAAAAG AAAAGAAGAT GTGAATTGCA ACATTTTGTT GGGTTTGATA
599501 CATATGGAGA TTTATTATTA AACATGCAAA ATCTCTGAGG CTAATGTTAA
599551 ATTGAAAAAC AAGTTGTCAG CAGCTATTAT ACACTCTAAG GCCAATTGCT
599601 ACATAATCAG AGGTCGTAAG AGAATGAAAG CTTAGGCATG TTTCAAGTAA
599651 ATATCTGGCA TATATGGCAC CTCGGTAGCA GAAAAAACTT AAAAATATAC
599701 CATTCTATTC CCAATGTCAG AAAAGGGAAT AGAAAATGAA GGATGGAAGT
599751 AACTCTCGCC AGCACAGAGA TGATATCCAC AATATTCAAT CCATATACCA
599801 AGGGGAAAAT TTTTTACAGG GAAGTAATAA AGATCAGAAT CGAGTCTAGG
599851 GAGTTTTCTG CCAAAATAAA TAAAAACAAG AGAATTTAGT TTCACAAGCA
599901 CAGAAAGAAC AGAATAAATA TCAAAAGAAT CTGAGCCATC AGAACAGCAC
599951 CTTCAAGGCT CCTACATTAA CCAGATGTCA TGATTTATAA ATCACATGCT
600001 ATAAATATTC AAGGAAAATT AGCCCCAAGA AAAAAAAAAG CAATTATGCA
600051 TTTGTAGTAA TAACAGCCCT ATTATTACAG ATGATAATTA TGATCTATGA
600101 TTACAGTTTT TGTAAAGAGG AATCTATGTT AGAATAACTA TGTGTATGAC
600151 AAATTCTGAA GAAAAAGTTT TAAAATTCTG CTTTCTAAAT CTGTGACACA
600201 TCATAGTCAA GAAGCACTAA TGGTAACTGA ATATCAAAAT GTACCTTGAG
600251 TGGATTAAAT ATTAGTATAA TAAAATATTG GAATTCACAA ATTAAAAATA
600301 CAAATATATA TTTTCTCAAA TGTATTAACA TTTTAAAATT TCAAGTTCTT
600351 GCCACTGAAA GACCTCACAA AGACAGGAAG AGTCTTGATA GAATCTACCA
600401 AGTAAATACT GGAAGATAAT TTTAGCTCTT GTATTAGTCA GCTTTTTGCA
600451 TTATTATAAA GGAATATCTG AGACAGGTAA TTGATAAAGA AAAGAGATTT
600501 AGGCCGGGCG TGGTGGCTCA CACCTGTAAT CCCAGCACTT TGGGAGGCTG
600551 AGGCAGGTGG ATCACAAGGT CAAGAGATCA AGACCATCCT GAGCAACATG
600601 GTGAAACCCC GTCTCTACTA AAAATACAAA AATTAGCTGG GTGTGGTGGC
600651 GCCTGCCTGT AGTCCCAGCT ACATGGGAGG CTGAGGCAGG AGAATTGCTT
600701 GAACTCGGGA GGAGGTGGAG GTTGCAGTGA GCCGAGATCA TGCCACTGCA
600751 CTCCAGGCCG GCAACAGAGC GAGACACCGT CTCAAAAAAA AAAAAAAAAA
600801 GGAAAGAGAT TTAATTGGCT CACAGTTCTG CGACTGTACA AGCATGGCAC
600851 CAACATCTGT TTGGCTTCTG GTGAGAGTGC CAGGAAACTT ACAATCGTGG
600901 TGGAAGGTAG CAAGTGCATC ATGTGGCAAG AGTGGTAGCA ACAGATGGGG
600951 GAGGTGCCAC AATTTTAAGC AACCAGATCT TGCATGAACT AACTGAACAA
601001 GAACACAGTT ATCACCAAGG GGGTGGTGGT AAGCCATTCA CAAGGGACGT
601051 GCCCCCATTA CCCAGTCTTC TCCCATCAGG CCCCACCTCC AACATTGGGA
601101 ATCACATTTT GGCATGAGAT TTGGAGGGAA CAAATATCCA AACTATATCA
601151 GTACTCAACC TATCTGGTCA AATCCCTCAA TTTCATTGAG AAAACTGAGA
601201 CTCTAAAGAA TGTTTCTGCT AAAAATCATA TACTTGTTGC TAATGCTAGG
601251 ATTGTATGAG TAGTGCTGCT TTGGGATCCA ATCTTGGAAA ATATTGACTT
601301 GAAGTCAACT TTATGTATTT ATTATCCAGG TTTATTTACA AAATAATTTT
601351 GTCAGGGCTC TGTTAGTGAG AAATGTTAGA AACCCAAGTC ATGCTCTCTT
601401 AATTCAAAGA GAGTGTTTTG GCTCTTGTCA CTCAAAATCC AGGATCATTT
601451 AGCTGCAGGT ATGGCTGGAT CTAGGATTCT TTGAAAAGAC TTTGTTGCTT
601501 TCAGTCTATT GGCTCTGCTT TCTTCAATAA TGGCTTTACT ATCCGGTGAG
601551 CTTTTTCTAT ATGGACACCT TCTGTATCTT GAGGCTAAAC ATCTACCCTA
601601 TTCAATTCCA ATGAGTAATA GTCTTTGTTC CCTAATAGTT GAAAGGAAGT
601651 CCTAGAATTG AACCTTATTG GCCTGGCATG TCATAGGTCC ACCTCTGGAA
601701 CTCAACAGGA ATGGAGGAGT AGATTTAAAC TCCATCCCTA CCAAATAGAA
601751 ACCACATGAA CTGACAGAAG GGAAAAGGTG ATTTTTAAGG AAAATCAATG

FIGURE 3UUUUUUU

601801 TGCTCTTCCA AGACCACAGC AAAAGCAGAT GTCTAGTATT TTCGGTTCAT
601851 TCATGTTTTA TTCTACAAAT GATTTCACAT CTGGCACACT TATTGTTGTA
601901 GTGTAGAAAG AGCATTGGGA ATGGAAACAA GAAGATCTAA TTGTATGGCC
601951 TTGAGTAAGT TGCTAAGCCT TTCTGAGTCT ATTTTCCTCA TATGTAAATC
602001 ATTTTAAAAA TATATTCATC ATTGCAATCC TATGAATGAT TTGAAGAACA
602051 AAAAAAACTT GGCAAATAAA GGCTTGTGTG CCAAAAAATA AATCCAGGCC
602101 TGCCACATTG CACAACTTTG GGGGACATCA TTGGCATAGA ATACAATGGA
602151 AAAAAAAATC AATGTTATCT ATAAAATGGG CTAATAATAG CTCTTTTACA
602201 AAGATTTAGC CTGAAAACAT TTTGAGAGTG TCAAGCACAG TGTTGGCCAC
602251 TGTTATGGAT TTAATTGTGT GCCCCCAAAA GTTATGTTGA TGTCCTCCCC
602301 AATACCCCAG AATATGACCA ATGAAGTCCT ACTGGAGTAA GGTGGGACAT
602351 TAATCTAATA TAACTGGCGT ACAAATAAGA ATAAAAGAGA GAGACACATA
602401 TGGAGGAGAG CACCAGGAGA AACACAGGGT AGAGATCGAG GCAGAGATTG
602451 GACTGAATTA TCCACAATAC AAGGAACACT AAGGACTACC TCTTACCCAT
602501 GAACGTGCAG CCACAAGAGG CAGCTCAGGA AAACAAACTT TATTATACTC
602551 ACAGGTCCTG AAGACAGGAG GCACAGCAAG CTATGCAAGG CCTCCTGGGA
602601 AACTCACCAG GGTGCTCAGG AGGCAGAAGA CAGGAGCAAG GAGAAGGTTT
602651 AGGCCAGAGT GGGAAAGTCA TGGCAGAGCA GTGAACAGTT TAGGATTGGT
602701 ATTTTTAATA ATTTTGGTGG GCTTTGGGTT ATAAGGGTGG TCCCTTGTTG
602751 CCTGGCACCT GGCCCTGGAA TGATTAAGAG GAGAAAAGTC ATCATTTGGG
602801 GTGTATAATC TAGGTAGAGG AGGTTTGGCT CTGGATTGGT TAGTTTACGT
602851 ATCAAAGACT TGCTGTAAGC CTGGGCCCTT TGCTAGCTCC AGGTTTTGGC
602901 TAGGCCCTGG AGGATAAGTC TCTTAATAGC GAGAATGATT TTTAACATGT
602951 GAAATCATCA TAACATGCAA AAAATTTAAA AAATACTTAT AATATGCTAA
603001 ATAAATTACA TCAATCATCA TTTCTTTCCA GAATTACAGA GAATCACACT
603051 GTATTCCTAC CTCCATTTTT GTTATCCTCC AGTTCATCCT ATGCACTGCC
603101 GTAGGAGTGA TCTTTATAAA ATGCAGAACA GATAACATGA CACCCTGGCT
603151 TATAAAACTT CAAGGTTCCC CACAGATTGA TGGAACGAGT CCAAGTTCTT
603201 TGGCAGAATA TTCAAGGCCC CCATTGATCT GGCACTTGCT TCCTTTCTAG
603251 GATCGTTTTT GCTAATTGCT GTGCCTGCTT CAGTTCTATT AAACCATCTA
603301 CAGCTCTCAG AGAGCACCAT GCTCTTCAGA GCAGCTCCTT ATGCCTACAA
603351 TGCCCCTTTT TTCTTTCCCA GTGGTAAACT ATTGCCCTTT TTAGGTTTAA
603401 TCAAGACTTT TCTCCTCTAT GTAGAATCAT GAGCTCCCTT TTTTCCCCAC
603451 TGTAGTCTAC TCAAATATCT ACTGTTACAA GAAAAGTTAT TCATGACACT
603501 TGTTAAAGAT GGTGAGGCAG ATTTTATTCA AGGAGGGCTA TGAATGTAGG
603551 TATAGGGACC AGTTCCACAG GGGTCTTGCA GTGGGGGAGA GAAATTTGAC
603601 TTAACTCCAA CAAGGACAAG TGGGGATGTA TATAACCAAG GAGCAGAGTG
603651 GATGTCATCG GATGGAAACT ATTAATAGGA AACATCAAGG CTAAGAAGTT
603701 TCTGGATAAA CTGACTTGAT AGGATTGTTG CTGAAGACAG ACCAGGGTAA
603751 TAAGATATTG AAAACAGTCA GACACCAAGG GTAGGAGATT TTTGCTAAAC
603801 TGGCCAGTAG GATTTTTGCT CAGACTGCAT TCTATAAGAA TAGATATGAA
603851 GGCCCCAAAT CAAGTCAGGT CAGAAAGGGC TTGGGAGCCT ACTAAAGTTC
603901 TGGTCAAATG AGTGAGTCTT TGTTACCACC ATAGCTCCTA AAGGCACTGT
603951 GTTGCTATTA TTATTTTATA TGCATTTGTC TTCCCAAGTA CACATAAAGG
604001 CAGAGATTCT CCATGATGTA TCTCAACATA TAGCACATAA GTGTTCAATA
604051 AAAGCCTATT AAATTAATGA ATAATAAAAA GATAAAGTAA TAAATGAATA
604101 ATCAAATGTT AAAAATAAAT AGTGAATGAG CCCAACAGTC TCCCAATGAA
604151 GTATTTTACT TAAAAGTTAA GAAATGCTTG ATTTTGTATT CATTGGCAGT
604201 GATTAAAAGA ACAGACTCTA GGGTCAAGCT GCTTGGATTC CTAGCTTAAA
604251 TTACTTATTT AGGTGACTTT GGGAAATTAT TACTTCTCTG CAAAACTCAG
604301 GATATAATAG TTCCTTCTTC ATTTGGGTTG TTAGGAAAAC TAACTGAACA
604351 TATATTTATA TTATGAAAAT TGTATTGTGA AGAGTAAATG AGAATATTGT
604401 AATTACTATA TACATTTTCA AAAAAATACT TTCAATGACA AAAGATTAGA
604451 GGCAAAACTA TTGTTTTAAT TGAAAGGGAT TCTTATTCTT TGTGTCTGCA
604501 TATATTGAAA ACTCTGAGCT TAAATTATGA ACAGTATTTG TGTAGTTTCT
604551 GGTACTTCAG TTTCTAGGAT ACACATAAAA ATGCATCTGT TTGTTGAAAA
604601 TAACAAAGTG CTTTTTTTCC TGGTTCATGT TGGTCAAATG CCTGCTGCAG
604651 TCAGTTTTAA CACCCATGGC TTTTCTCTCT GTGTATAGGA TGAAGACCCA
604701 GAGAGGGGTT ATGTAAGTCA CCATAGTTCT TATTGATTCA AACCTTGTTG
604751 AATTTTACCT AAAAACAAAT TTCTCACGTG TAGAATCGAC TCACACTGTT
604801 GCCAGGTTGT ACTACTAATT TTTATTTTTA ATTTTATTGC CCTAAGAATA
604851 TTTATTTTTA TACTACCCAG CTGCCACCAG AGATTTTGTA TCCTAACTAC
604901 ATACAATTTT GTTTTACAGT AAGTAGAATA AAAATAATTA AAATAAAATA
604951 TTCCAAATAT GAGGGATTCA TAGAAGCAAG TGGCCAGGAA AACTTTATGG
605001 AGAAAAAGAG ACATGAGTTG GGATTCAGAA GATGCTGGAA ATTGGAACAG
605051 GCTAGAAGAC AGTATGGAAG GCACTCCAGG CCGGAGAAGT GGTGTCAGCA
605101 AGTCTAAGGG CAGAGGCATT CCTGTATTTT GGAGGTGGAT AACACCTCAA
605151 TCTGCCTTAA ACATTAGGTT TATATGGGGG AGGGAATCAG AATATAAATT

FIGURE 3VVVVVVV

605201 TAAAAATTAC TATGGGGCTG GGCCGCGGTG GCTCACGCCT GTAATCCCAG
605251 TACTTTGGGA GGCTGAGGCA GGTGGATCAC GAGGTCGGGA GTTGAACACC
605301 AGCCTGGCCA AGATGGTGAA ACCCCATCTC TACTAAAAAT ACAAAAATTA
605351 GCTGGGCATG GTGGCAGGCA CCTGTAATCC CAGCTACTCT GGAGGCTGAG
605401 GCAGATAATT GCTTGAACCC AGGAGGCAGA GGTTGCAGTA AGCAGAGATC
605451 ACACCACTGT ACTCCAGCCA GGGTGACAGA GTGAGACTCT GTTTCAAAAA
605501 AAAAAAAAGT ATTATGGAAG CTTTAAATGT TAAACCATGA CATTACAACT
605551 CTACACAAAA AGAAATAGAA AGTTTTGAAG ATTTTTAAGA TAATAATGCT
605601 GCCTGAAGCA GGTGGTGTGC AGAATTGCTT GGATAAGCTA GAGGTTAAAT
605651 TCAGGCCTGA CTTCAAGGAA ATAATCCCCT TCCACCAGCA CTGTAGAGTC
605701 TAGATACCAG AATGTAGCAA TAGGAAGTCA TCTTCAGAGT GTGTTGAGAA
605751 TGAAAGGGTC AGCAAGAGAA AGGTCAAAAT AAAATAGTTC ACATTAAGAG
605801 TCAGGAAAAA GAGGAGTCTG AAACTGGAAG CCTAAATTCA GGAATGGATT
605851 CTGGGATGGA CAGAAGAGGG CATATAGTGC TGTTATTGCA TATAAACATA
605901 TCACCTATGT CACGGCAAGG AGTCAGCATT TAGGGCAGTA ATATCACTTG
605951 TTAAAAAATA CTGCTGCCAG GATGGCCTGG AAACTCAATA AGCCCTAATC
606001 AGGAAAGAGT AGAAGCAGAG GGACCAATTA GCAGACTCTT GCAGTAGTCA
606051 AAATTAAGTG TAATAAGGGC CAGAGGTGGC ATGGTAGAAA AAAGACTATA
606101 GGGGTTGACA CAAAGAAGAT TCAGGAGAAA AACCCTCCTT AAAAAAAAAA
606151 AAAGTTTTAA AGTTAAAACC CTTTCATTTG AAGCAATTGC ATATGTTAGG
606201 CAATTTCTCC AAAATTTAAG TGCTAATTGA TAGATTCTGA AGCTGTCTTG
606251 CAAGGAAGTT CTTGTACCCT TAGAAAAGTC ATTCTCTCAG TGACCTGGTT
606301 GCTGCATTAT CATCTCAAAT GCCATTTTTT TCTTACTGTT TCATTACATT
606351 GTCACCTTCA AAGGACAAAA TTACATGTAA GTCATAAATC TTATTTCCCT
606401 AAGACCAAAA GAAAATCTTC CTTGAAACTC ATAATGAAAC TCTTTCCTGT
606451 TAAATGCCAC ACAGCAGACA CACGTTAGAC CTGAATTCTT CCGTATTAGA
606501 CTCAACATGA ATTTGCTATT AAATAGCTTT TAACTGAGAT CAAACAATAA
606551 GAACCTACAA AAGAGCAAAT TCTCAGTTCA CAAAAGACTA ATTGCCAAGC
606601 TTGCAGCATT TATAAACATC AAGGTCAATG TGAAATGTGG AAGGTCAATG
606651 AAACTTGCTG GCAAAGAACC ATCATTGCAA TGTATAGCAC ACCATCAGCT
606701 TTTCCATATA CCTCTACTGC CACTTTCTGT TTATAAAACC ATAAGGTTAT
606751 TTTGATCCAT TTTTACTTTT TTCCCTCAGT CAGCATTCTA TGTATATAAT
606801 GCAAGCTATC TTCATCTTGG CAATTTATCT ATCTAAAGTA GAAGTTTTCT
606851 TGGACCAAAA ATCTATGTTG TTCTGATTAA TGCCAGTGTC AACTAAAACA
606901 CTGATCTCTT TTCCTTTTTT TTTTTTTTTT TTTTTGAGAC GGAGTCTCGC
606951 TCTGTCGCCC AGGCTGGAGT GCAATGGCAC TATCTCGGCT CACTGCAAGC
607001 TCTGCCTCCC AGGTTCATGC CATTCTCCCG CCTCAGCCTC CCAAGTAGCT
607051 AGGACTACAG GCGCCCGCCA CCACACCCAG CTAATTTTTT GTATTTTTAG
607101 TAGATACAGG GTTTCATGGT GTTAGCCAGG ATCGTCTCGA TCTCCTGACC
607151 TCATGATCCA CCTGCCTCAG CCTCCCAAAG TGCTAGGATT ACAGGCGTGA
607201 GACACCGCGC CTGGCAAAAC ACTGATCTCT TAGTTACTCC TTTTTCCTGC
607251 TTTTTTGTCT TTGTTTTATG CTGATATTTT AACATGTTTA TTGGATTATA
607301 AGTCACTCTT GGTAATATGA GCCCTTGGTT TGGTAATAGA GTATAATCAT
607351 AGTAAATGAT ACTCCACATG GTTCTTGGCC TTCTGATTCT TAGATTTTAA
607401 GTCTCAGAAA AGTATACAAG TATAACATAT TTTTATTTTA GGACTCCTCT
607451 GTGCTGTCGT ATAGCTGGCT CAGAAGAGAC CAACTTTCCT GAGGTGATGT
607501 CTTCCTTGTT TCCCCATTGT ATGCCTACTA TGTGCCAGAT AGTATGTTAT
607551 ACCTTTCTTA TATGTAGTTT TATTAATCCT CATAAAAACT ACAGGCTAAT
607601 TGTTATAATT TTTTCATTCT CCAAATAAGG AAATTTAAAT CAGAAATATT
607651 AAGTAACTTA TTCAATATCA AACAGCTTGT AGGTGGCAAA GTCATGAGGC
607701 GGATTCATGT CTGTCTGACT CCAAAGCTCA TGCTCTTTGA TTACATTTGG
607751 TTGAATTTTT GACTTTCTGC CTACATACGT CTTAACAAAA TCCATATAAA
607801 ACATATTTTA TCACTATATG TATGACACTC TTGAATTAAG CAAAAGGCAA
607851 GAAAACAGTC AAGTTTCTTA GTAAAGAATA ATGCTAAACT CTTATTGCAG
607901 CTTTTTGGTA ACAACTGTGT CTGCGTTGAA TAACTATGTC TCCAAATGAC
607951 TTGATTTGAT AATTGTTGGA TTATTTAAAG TATGGTGTTA ATGAGTTTCT
608001 CAATCTGCTT CTTATTTGTG TACAAAGAGT TCATTATGCC TGATGAAGGC
608051 CTGTTAGCAA AAGGAACCCA AAAAAATAAA TACAAAGCAA TGTGCCTTTA
608101 GATTATATGA AGTCGAGTAA AGGTGGTGAC CTGGCTAATA CAAAAAAGCT
608151 AACTGCATTT TAGGTTGCTA TAATTTGACA AGAAGACCAT TTTTACAAAA
608201 TTAAAGAGTT CTTTTATAGT CTACTCTGGG CAGTTTACAT CTGGTATACA
608251 ATGATCAGTT CCAGATTATA CATTTTAAGG TCAGCTTTAT TAAGGTATAA
608301 TTTGTCCAAA AGTAAGGTAA CCAGTATGAT GAGATTTTTA TTTATTTTTT
608351 ATTTTTTTAA ATTTTATTTT TTATTATACT TTAAGTTTTA GGGTACATGT
608401 GCACATTGTG CAGGTTAGTT ACATATGTAT ACATGTGCCA GAGATTTTTA
608451 AAATAAGTGT CTGATAGATC AAGATATGTT TAGCCTACAG TCAAAAATTT
608501 AGGCAGAAAA TGGAAAGGAA AAAATAGGTC TCTTCATTTA TCATTTGTAT
608551 TGCCACATGC AAATTCAGAG GGCAAAATTA AGACCAAATG AATGAAAGAT

FIGURE 3WWWWWWW

| | | | | | |
|---|---|---|---|---|---|
| 608601 | AAATTAATGT | TTCCTGAAGA | CAAATTTTGT | ATTGATTTAA | TATTAATCAA |
| 608651 | GAAAGCCCAG | AATAAAACAG | ATAGGCACAG | AACTTAGTCA | CAGGGATGCA |
| 608701 | AATAGAATAG | TTCCAGAATG | TCCAGGATGT | TCAGGCTCCT | CCCAATTCTA |
| 608751 | AGATCCCTTG | CTTGAATGAT | AGCTATGATA | TTCTTCTTTC | ATTTTATCTA |
| 608801 | TTAACATGTA | TCTGTTATCA | TGTAATGTGG | ACCCAGTCAC | TTTTCACCTT |
| 608851 | CTTTCTCTTT | ATTTAAGCAA | CTCAAAAAGA | AAGTTTTTAT | TTCATTGGTT |
| 608901 | TGAGAAAAAA | TTGTAATTTC | TTCTTGGAGA | AATCTAAATT | TTATTATCAA |
| 608951 | ATAGAGAAAT | GGTTTTAATA | CCCTATCCTA | AAGGCTGAAT | TTATAAAGTC |
| 609001 | ATTCAGTCAG | CAAACATATA | TTGAGCAGCT | AATAGAATGC | TAATACCATA |
| 609051 | AGTGCTGTAA | TATGTGGTAG | TTGAATGAAA | GAGGCTTAGG | GCAGTCTCAC |
| 609101 | TGGATCTATT | TGAATAAAAG | AAAGTTTCTT | ACAGGGAGTA | ACACTTAAGC |
| 609151 | AGAGTCTTGA | AGGATGAGTA | AAATGTGGGT | TAGAAAGGCA | AAGAAACTGT |
| 609201 | GTATTATTAG | CAGGAAACAC | ATATAAGAAA | AAGCTACACA | GATGTGAAAG |
| 609251 | GGAAAAGGCT | TATAGACCTA | TTAGCATTTT | CTTATTGTGG | ATGTCAAAGC |
| 609301 | TGTGTGAAGC | CAGTTTTCAG | AGATGTGACC | AGAGAGACTG | ATAAATGAAA |
| 609351 | AGCAAGCAAT | AGAGAAAGGG | CAAAAGGTAG | GGAAAAATAC | TGCAATATTT |
| 609401 | GTTAAACAAA | GACTACTATG | AAATTATATA | ATGAATTCTT | ACAAATCATT |
| 609451 | TTTAAAGACC | CTACTATGTA | AAAATGAGAC | AAAAATATGA | GCAGCTAATT |
| 609501 | TTCTTAAAAC | AAATATAATG | ATTAATGAAA | ATAAGAAAAT | ATATATTTAA |
| 609551 | TTTCACTAGT | AGCCAGTGAT | ATGTTAATTA | AAACCAAAAT | TAAACGAAGT |
| 609601 | TTTGGAAATA | ATAGACACTA | GGGACTCCAA | AAACTGGAGG | GTGGGAAGGG |
| 609651 | GAAGAGGGTT | GAAAAGCTAC | CTATTGGGTA | CTATATTCAC | TATTTGGGTG |
| 609701 | ATGGGGTCAC | TGCAAGCCCA | AACCTCTACA | TTATGCAATA | TACCCATTTA |
| 609751 | ACCAACCTTC | ACATGTACCC | CCTGAATCTA | AAATTTAATT | TAATGAATAA |
| 609801 | ATAAAACACA | AAAAACAAAA | CTAGATTACT | TTTTTAACCT | ATCTAGTAAA |
| 609851 | AACTGAAGAG | AGTGATACTA | TCTGTGTTAA | TAAGAGCATA | GGAAATTAGA |
| 609901 | ACATTGTCAT | TTACTCTTGA | TAATAATTTA | AATTGATATA | GACTTGTGGT |
| 609951 | ACACTATTTG | GAAGTATGTT | TTTAAATGCA | CATATTGTTT | AACTCAGGAA |
| 610001 | CTCCATATCT | ATATAACTAT | TCTAGATATA | TATGCAATAA | CCTAATACTC |
| 610051 | ATCAGGAAGA | AAATGGTTGG | ATAAATTTGT | GGTTATATAT | GTACTGGTGA |
| 610101 | ACATTATGAT | GCAGTGAAAA | GAAGGAGGTA | GATTAACATC | ATGAGAGGTC |
| 610151 | TCCAAAACAT | GTAATCAAAT | TTAAACATTC | AAAAGCAAGT | TAAGTGCAGT |
| 610201 | ATATAGAGAG | TAATCTCATT | TACCTTAAAA | ATTCACAAAG | TAAAACTACT |
| 610251 | CATTTCATAT | CTACGTATAC | AACCATTCCT | GGCATAAAAA | AACATCTGAG |
| 610301 | AGGTTACACA | TCAAAATGAT | GACAGCAGAG | GGCTGGGATT | AGATGAATGA |
| 610351 | TAAAGGGAAT | TGTCATTGTT | CTAAGTTGTT | TAAATGTTAA | TAACGATAGT |
| 610401 | TTGTGTATTA | TAGTGTGATA | TAAATCATAA | GTATTATTTT | TAAATCTGTG |
| 610451 | GGGAGCCTTT | GAAAGGTTTT | AAGCAGGGAA | ATCACATAGG | CACATTCGCA |
| 610501 | TTTTAGAAAT | ATTTATCTGC | CAGCTGAATA | TAAGGGGGAA | ATATAAGCAC |
| 610551 | GGAAATTAAA | TTGGAGACAG | GGAAGTCAAT | AAAAAGTGAT | GGCAATAATC |
| 610601 | CAGAGTAAAA | AATATAGGTA | GACTTATATA | AAGCTGTGTA | ATTGTAGTGA |
| 610651 | AGATAGAAGA | AAGAGGGTGA | CTAAGAAAGA | CAGGTTTTCA | CTACATAGAA |
| 610701 | ACCACAGGAC | ACCACCAGTT | GAGATTAGAA | GACGACTCTG | AGGAAGTGGT |
| 610751 | CTAAATGAAC | CTCGAGTTTC | CAATTTAGCA | ACTAGCTAAA | TGGTCAAGTC |
| 610801 | TTTTCATGAA | GATAAGGAAC | ACAGTGTGGG | GAGTGAAGGG | GTAGGCTAAG |
| 610851 | GGAAATGGGA | TTCTTAGATC | TTTGCTACCC | TAAGGAATTT | GGGATTTTGA |
| 610901 | ATAGGAAAGT | TATCTCAAAA | TTTTTCTGTG | AAATATTTTT | TTCCAAGAAA |
| 610951 | AATTACCTCT | TCTCTATAGA | AGAGGTTAAT | GGCAAGTGAG | TTCTATCTAA |
| 611001 | ACATCCTATA | AAGCTTCAAG | AAATTTCCAG | ATTTTGTAAA | AAGTTGTTTA |
| 611051 | TTCATTTTTT | TTCCTTGATC | AGTCCAGGGA | GCAACTACTT | CTACTTGTCA |
| 611101 | TGGGTATATT | ACCATCGTGA | AAGAAAGGGT | TTATCAATGT | CATCCACTAA |
| 611151 | AGAGTTACAC | CCTTGCCACC | TCCCTTACAT | CCCACTCATC | AACTGCGCTG |
| 611201 | GCAGACACTC | AAAAGCTGGG | AGAATATTTT | CTGTCAGGAA | GGTCTAAGTG |
| 611251 | CACACTGGCA | TGTAAATCTT | GACAAGCTTG | TATTTTGGGG | GTTAGTGATT |
| 611301 | ATTTTTTGTC | CTTAAGTTGT | CTCAAGGTTG | TAGAACTTAA | GTGAAAGAAG |
| 611351 | GATTCCATCC | AGGCATGCCA | GTTGTTTTTC | TAAGTTCAAA | CCATACTATC |
| 611401 | TTTATTTAAT | CTATAGACTT | TGTTTTACTG | TTAAAAGATG | AAAATTAAAC |
| 611451 | CTCTTTCGTG | TATAAAACTG | TGACATTAAA | ATTAGATTAG | AGATGACCCG |
| 611501 | TGGAATGTTT | GCACTTATTA | ATCACAATTC | AACCTTGAAA | AAAGAAAAAG |
| 611551 | ATTTCTATTA | CATAATGGTA | GAATGTATAA | GACAAAAAAA | AATGAACTCA |
| 611601 | GTCACTCATC | AGTTTTTAAG | TGTGAAAGGT | ACAATGAACA | AGATAACATG |
| 611651 | ACATTTGCCT | TTGTGGAAAT | TATAATAATG | GTGAGGTTGT | GATAGCAAAA |
| 611701 | GTGTGGGCTA | ATGTGGAAGC | ACATCTCAAA | GGCACCCACA | TTGGTAGAAG |
| 611751 | GATGACAAGA | TTGAGGGGAC | TCTTTTGTTT | TTCTTTTCCA | TTTATTTATT |
| 611801 | TAGAGACAAG | ATCTCACTGT | GTCTCCCAGG | CTGGAGTGCA | GTGGTACAAT |
| 611851 | CATGGCCTAC | TGCAGACTCT | GGGCTCAAGC | AATCCTCCTG | CCTCAGCCTC |
| 611901 | CCAAAATGCT | GGGACTACAG | CTGAAAGCCA | CTGCATCCAG | CCTGCTTTTT |
| 611951 | TCTTTTAAAA | CTCTTAAAAT | TTGATTGAAA | GTGAAATTGT | AAACGTAGAG |

FIGURE 3XXXXXXX

612001 TTGGAAGTTC TGGAACTGGA AAATAAAATT GCAAAGGAAG AAAAGAAAAT
612051 TTGCATAAGA CTTATCCAAA GTAAACAAAT CTAAAGATAT TGAGAGAAAA
612101 ACAGAGAGAA ATGTTTTCTA CAGTAAAAAT TTATTCACTA TTGAAGATGA
612151 AATTTTCTTT TAATAGTGAA GGAACACAAG CCATTGATTT GTGAAACTTT
612201 CTTTCCTTCC TTTCTCTTTC TCTTTCTTTT CATCATACAT CTAAGCATCA
612251 GGCATTGAGC TAAGCTTATG AATTAAAAAA AAAATCCCCT GTCTTGAGAG
612301 AGCTCACAAA AAATTGTTTC CAATTTTTAT GCTCTTTAGT GTTATCTCCA
612351 GGGAGTTAGA GGCAGTGACT CTCCAGGACT CATTACCTAT TAAGGCAATG
612401 CTCTTAACTG TCAAGGTACC TCATGACATA ACCAGTTAAA ATTTTTATCT
612451 CTAGCTATTC ACTTCTAGAT AATAGGAAAA GCAAAAATCA AGTACAAATT
612501 CTCTTAAAAG CAAATTAAGA AGTTGTATAT AAATATCACT CTTAATCTTA
612551 TCTTTTCCGG TTTTTTGTTT TTGTTTTTGT TTTTCTTGGT TTTTTTTGTA
612601 GTGGAAGAGA AGGAAGTAGA GTAATATTTG GGTCTTTGGA AGTTATGTTT
612651 CAATGTGACT TCATTTCTCA TTCATTTTCT GATGCAGTGA CAGACTGAGA
612701 ACAATCCAGG CAGATGAGTG GCATCTGGGT TGGTGGATAG ACTCAGAAAT
612751 AATTGCCCAG ATAGAGTAAG AAGAATAGGC TAGAACAGCC AAAATTACAT
612801 CCATGAAGTC TGTTTCAAAA TCTGAGTATG AGATAGAGTC ATCAGAGGAT
612851 ATTGACACAG TTAATTTAGG GACCAGGAAT GCTAAAAAAG GAAAAGCCAG
612901 ACTATCAGCA TAGAGTCAGA TTCTGTTGTA AGTGACAGAA AACCCCAAAT
612951 AAAAAGTAGA AAAATTATTC CTTTCACAAA TAAGCAACAT CCAGAGGTAA
613001 GCAATCAACA GCTAGTAGGA TAGCTTCGTG AACCTCCGAG ACCCAAGATC
613051 CTTCGACATA CTGAACAGCT GTCTTCAGCA CACTGTCCAG GATGGTTGTG
613101 TAAGTTGCAT TTTTCAAGAA GGAGGAAGGG GCACATATAG TCCCATTTCC
613151 TCCTTTCAGG GATACTTCCT GGAAATTGCA AACACTACTT CCATTTCCAC
613201 TCACTGATCA CATAGCTTCA TCTGGATGAG TAAGAAAGCT GGAAAAATAT
613251 GGTCTTTATT CTGGCCAGCC ATATGGCCCT TAACGACAGG GGTTTTGAAA
613301 CTGGGATGAA AGAAACAGGT ATGGAAAGGC CACTGTCAGT CTCTGCCACC
613351 ATGAGCTCAG ATCATGACTA GAGGTATAGG ACTTTCCTCA ATCATCAAGT
613401 ATGAACTGAG GTTGTTCCTT TTGGAGGATA CCTTGCCATG TACTTTAGGG
613451 GCTGATTTGG CCTTTTAAAA AGATTTTTTC AGACCGAAGA TTTTCAAATA
613501 GTAGAGATTA TTCTTACTTT TTTAACTAGA TATGCATCAT AAATTTAAAA
613551 AATTTCAGGG AACTAAAACT TCTGTTTCAT TCAACTGAAT TTTTATAACA
613601 GTCTTATACA CTTATCTATT GTGTATGAAT GTGTTAAAAA TTTGGTCAGT
613651 CAATACTTTT AAATACAATC ACACATACAC ACATGAATGC TTGCCCTTAT
613701 GCAACCATTT TTCTTTGGTC TATCAATATA TGCCATTAAC CTAAAAATTA
613751 ATCTCCTCTT CATTTTTATT TCATGTTTAT TTCTCGACAA GCCTGTTCCA
613801 CTATCCAGTA TTTATGTTTG CCAGCAATTC TTTTCTATAA ATACAGTTTG
613851 CTAGATTATA GCTAAATCTA TACTTAAATA CAAACTCTCT GGCACTTTCT
613901 CCAAACTCAA GGTTTGTGAT TATAATTAAG CAATAATATT GTCACTTGCT
613951 TTTTTCTTTC TTGAAAGTAC CTAATCTCCT TAGGTATCTG CCCCTTAGTG
614001 CTGTAAAGAT GTGATTTGAA AAGTAAGTTT AAACCGTTCT TTCAATTAGG
614051 CTGCACTTAT TTTTATATTC CCAGCCTTAT ACCCAGATTA CCTGGAAGGT
614101 ATATATACTC AGTTAAGACA CATTCGATCT GAAATCTATA TGACTTTGAG
614151 TATAAATGGG CACCTCTTAA TGATTGAGAT TGAGCCAACT GCTCATTCAG
614201 CTGAGGTGAA TTAAGTCTTC TAGGGCACCA GTGTGCCATT TAGTAAATTA
614251 CATCATCCAG CACACTAAAT GTGCCTCGCA TGGGTGAACA GCTTCCTTCC
614301 AGGGTGTACT TTCCTCCCCC TCATTCTCCA TTGACCCTAC CTTATTGATG
614351 TCATAGGGTG ATTCATATGA CTCAGTATTT ACCCACAGCC TCAGACAATA
614401 AGACTGCACC ATTATTTACA CCACTGCAGA ACACATGCGC CAGTATGTAA
614451 AGGGTAAACG AGAAAGTTAT TTTGTTTGGA TTTTTTGTAA GTCAAATATA
614501 AACAAAAGAG CATCACTATC CTCTAGATTC TGAAACTGTA AAATATACTG
614551 TCATATATTG CTTCTCGGCC TTTTGGCTAA GATCAAGTGT AAATTTACCA
614601 TCATATAGTA AAATGGCTTA GCCCCTTAAA AATATCAATA AACAAGCATC
614651 TTTTAAAAAA AACTATTAAC ACAACAGTAT GTACATAAAA CAAGCCTATT
614701 TAAATAGCAG TAAAATTGAA TATAATACTT TGAAAGCGAT AAGTTTTTAT
614751 TTTTCACTTG CAAATACAAA TGTTCTTTTA ATTTTAACTC AGTCCTATTC
614801 TCTTAGATAT TAAAACTTTA GACATTTATT GGATCCTGTT TTGGAAACTA
614851 ACATCTAGGG CATAAAGTAG TTTTTGTGGT GCCATAATTT GTTAAATAAT
614901 ACTTTGAAAG TGGCTGGGTG CCCAAAGAGT TCATGCAGAA ATAAAATGCA
614951 CTCAAACTGC TTCCAAATGT TTTCCTCTCC ACATATATCA CATCAGAAGC
615001 TGCTGTTTCT CTCACACTGT CACTATATCT AAGAAGCTAT AATCATTCAC
615051 CACCCCTAGT GGAACATTTT AGCAAACTAC TCAAATTTAC ATCCAAGCCA
615101 ATGTTTAAAA TTAAATTAAA AGCATGTATG TTAAGTGAAC CAATAATCTA
615151 ATGATACAGG GGTCTGAAAT TGCCTTGGAA CTAGCTCTGA AGAATACATT
615201 AAGGAGGGGC ATTTTCAACA GTGAACAACA CCTGCTTGCT TTTTATCCCT
615251 CACTTTTTCT CTTGACTCTC CTTCAATATT CTTATGGGAC GGGATGTATT
615301 TGGGTCCTCA TTTTGAACTC AGTTTAATGG CCTTTCAAGG ATAGCCTGAT
615351 GATAAACAGA GTTGAAAATG GTGGCACAGC AAGGGGCTGG AAGATGTGAA

FIGURE 3YYYYYYY

| | | | | | |
|---|---|---|---|---|---|
| 615401 | TGGAGATATT | ATTCCAGGCA | GTCTCAACAT | GCCCAGTTTT | AATGTGACTA |
| 615451 | AACAGTCATA | AAGTCAGGCT | TCTTTGAGTC | TGTTTCCGTT | TTCTCCCTAT |
| 615501 | TATCAGGAAT | GAGTGTTGTC | TCATATCAGA | CTTGAGAATT | AGGTGAATAT |
| 615551 | ACGCCTCAGT | GGCATCCAGC | TTACAAAAAG | GAATAGCCTC | ACTAAAAGTT |
| 615601 | AGAAGTTACT | TGAAACTGTA | TAATGCCTGC | CTCTTTCAAA | CCCATTTCAC |
| 615651 | ACTTATGATC | TTATTTGAAA | ATAGAGCCCA | ACACACTGTT | ATTACTTTGC |
| 615701 | TTCGAGGCCA | TAGTTGAGGT | GAAATTGGCT | GGCTCCTATA | CAGGAGAGTT |
| 615751 | AGGCCTGCAG | AGAATGAATG | CTAAGTCAGT | CTCTCCCCTC | ATGGAATAGC |
| 615801 | ATCCCTAGCT | ATGTGCCTCC | CTTGTCTTTC | ATGCTCACAT | AAGCAGTCCA |
| 615851 | AATTGCTCCA | CCCTCAAGAT | CGTCTCTCTG | TCTGTCTCTT | AAATACATAA |
| 615901 | ATGAGAAGGC | ACATATGCAA | CCCTGGGATA | AATGTTGGGA | AGGATATATG |
| 615951 | TGGCCCATGT | CTGGCTGTTT | GTATTATTCA | GTGTTCACCA | ATCTGTCTGG |
| 616001 | GAGAGAAAGA | CTATATGAGA | TATCAAGAGG | GACTTGACAG | GTCAGAACAT |
| 616051 | TTTTAGGACT | CAAGTGATAT | TTTCACTATC | TTGCATGAAT | GTTGTCATTT |
| 616101 | TACTTTTAGA | AGTTTAAAGG | AAGTTTAGAA | GCAAAACATG | GGTACATGTT |
| 616151 | GTAACTCCCA | TTTTTAAATG | TTACCTTTAC | AATTAACCCC | TATATGCAAC |
| 616201 | ATGCCATGCC | AAGTTCTATT | GCACGTATTA | AAATGAGAAG | CTTCTTCAAA |
| 616251 | TAATTTATTG | TAAGATACAT | GAAAAGAAAT | ACCTATACTG | CAAGTTAAAA |
| 616301 | ATGTGATAAT | TTTACACATG | ATAGAGAGAA | AAGAGCCACA | GAGAAAGGTC |
| 616351 | TATTTTGTGC | CAGGCACTTT | ATAAACACTA | TTTTGTATAA | TTGTCCTCAT |
| 616401 | AACATCAAAT | TTCCCACACA | TTACCAAAAT | GAGAACTGAG | GCTCGGGGAG |
| 616451 | TTTAAGTGAC | TTGCATAAGG | TCATGCAGCA | AGCTATGCAC | AGCAAAGTTT |
| 616501 | TGAAGCTGGA | TCCCTCTGGC | TCCACACCTG | TGCTCTTCCC | ATTGCAGCTT |
| 616551 | TGCTGCCTCC | TGAGGGAGCA | CAGATGAGGG | CAAGATGATT | CCAGCAGCAG |
| 616601 | ACAAATAAAA | AGCCTCTTAG | AAGAGGTGGC | ATTTGAGCAG | CGTATTTAGA |
| 616651 | ATGAGTCAGG | CCAATATGGG | GTATTCTTTC | TTTGTGCTAG | AAGGAGTGAA |
| 616701 | CAACACATTC | AAATAACAAT | GAATCTTCCT | GTATGTTTGC | AGGAAAATGT |
| 616751 | GAAGGATTCT | GAAGCTGTTC | TTTTTTATTT | TTATTTTTAT | TTCATTTTAT |
| 616801 | TTTTTTTTTG | AGACAGAGTT | TTGCTCTTGT | TGCCCAGGCT | GAGGCTGGAG |
| 616851 | TGCAATGGCC | CAATCTCAGC | TTACTGCAAC | CTCCACCTCC | CAGGATCAAG |
| 616901 | CAATTCTCCT | GCCTCAGCCT | CCTGAATAGC | TGGGATTGCA | GGCATGTGCC |
| 616951 | ACCACACCCG | GATAATTTTG | TATTTTCAGT | AGAGATGGGG | TTTCTCCATA |
| 617001 | GTGGTCAGGC | AGGTCTCAAA | CCCCTGACCT | GAGGTGATCT | GCCCACCTCG |
| 617051 | GCTTCCCAAA | GTGCTAGCAT | TGCAGGTGTG | AGCCACCACG | CCTGGCCATA |
| 617101 | AAGCCACTCT | TATGTCTTGG | TTTTATACTC | ACCGGTAGGG | AGATTTTGGA |
| 617151 | ATTTTTTAAC | TGAAGAGTGA | CATAATCTAA | ACTGGGAGGA | CTCGGGGAGG |
| 617201 | CATCCACTGA | AGTGTTTACA | CCATGCACAT | TTGCAGGTAG | AGACATGGAA |
| 617251 | GGAAATCCCA | TGTCTTACCT | CATGCAAAAA | ATAGCTACCT | GGAAAAGTGG |
| 617301 | ACATATCTTG | CCACCAACAC | CCTACCACCA | GTACCATTGC | ATACATGTCA |
| 617351 | TACATTTATC | ATATGAGAGT | GGATATAAAG | TCATATTAGG | GCCTTGTTTA |
| 617401 | GTTTCATTTT | CTTTGGCTGC | TTTCAATTGT | TTCAAGACTG | ATTGTGTTCC |
| 617451 | CTGATTATCT | ACAAAACCAA | TCAAGTAGTA | ATTATTAAAT | AGTAACATGG |
| 617501 | AAATTAACCA | AATTATCCTG | CCATCTCATC | CACACCATAT | AGATGCCATT |
| 617551 | TTGACCTGAA | AAAGCTGGTA | TCTTAGCCTT | AAATGAAAAA | TGTTTGATAT |
| 617601 | GTATTAAAAC | ATTTGTTCGT | AGATAGTGCT | GCCAAGGATG | TTATTGTATC |
| 617651 | TGTGAGTAAA | ACTAAATCCA | GAACATTCTC | TTTTAAACTT | TGTTTATGAG |
| 617701 | AAAGCGACAA | TGTGATATAG | GTGACAGCAA | GACTCACACT | AGCAATGAAT |
| 617751 | GGCCAGTCTG | GTCTATAGGC | AGCTTTGGAA | AACTACAAAC | AGGCAGATGC |
| 617801 | AGCCTGCCTC | ATGACCTCTT | TATCTAGTGT | GCTAAAAGTG | CAGACCTCAC |
| 617851 | TTTAATAATG | TGACAGATAT | ACCCACAGTT | CATAAATATT | AAATACATAG |
| 617901 | CACACTTTGG | CTGCAGAGCT | AAATAGATCT | AGCTCTCATA | CATGTTGATA |
| 617951 | AATGCTGCTT | AACAACGCCT | TAGCTGACTC | CTTGGCACCT | GAGGTGTAAA |
| 618001 | ATGGTTTTTT | AGAAGAACAT | ATAGTTGGCA | GGGCGCGGTG | GCTCATGCCT |
| 618051 | GTAATCCCAG | CACTTTGGGA | AGCCGAGGCG | GGTGTATCAC | AAAGTCAGGA |
| 618101 | GATCGAGACC | ATCCTGGCTA | ACACGGTGAA | ACCCCGTCTC | TACTAAAAAT |
| 618151 | ACAAAAAATT | AGCTGAGCGT | GGTGGTGGGC | GCCTGTAGTC | CCAGCTACTC |
| 618201 | TGGAGGCTGA | GGCAGGAGAA | TGGTGTGAAC | CCGGGAGGCA | GAGCTTGCAG |
| 618251 | TGAGCTGAGA | TCGTGCCACT | GCACTCCAGC | CTGGGTGACA | GAGCAAGACT |
| 618301 | CTGTCTCAAA | AAAAAAAAAA | GAAAGAAATA | CTTTGGTGTA | ACTCTAACAA |
| 618351 | AATATGTACA | AGAACTGTAT | GAGGAAAGCT | ACAAAACTCT | GATGAAAGAA |
| 618401 | ATCAAAGAAC | CAAATAAACA | GAAAAATATT | CCATGTTCAT | GGATAAGAAG |
| 618451 | ACTCAATATT | ATTCAGATGT | CACTTCTTCA | TAAGTTGATC | AACAGATTCA |
| 618501 | ATGCAATGTC | AATCAAAATC | CCAGCAAGTT | ACTTTGTGGA | TATCAACAAA |
| 618551 | CTGACTAGAA | AGTTTATAGA | GAAAGTTTAT | AAAGAACATA | TAGTTTAAAA |
| 618601 | GTCTGACCTC | AGGGAAAAAA | CAGCTAGGTA | GGAATCTGCC | AACCAAGGTA |
| 618651 | GCCTGTACGG | TGGCTAATTG | GAAGGACATG | TTTTTTCAAG | TTCACTCGAC |
| 618701 | CCTTCCATCA | CTTCTTAGAT | AAAAGAACTT | TAGAATTTTA | AAAGTTTTGG |
| 618751 | AAATTTAGTC | TGCCCCGATC | CCTGAACACT | GGGTCATCAT | AAGCATATAA |

FIGURE 3ZZZZZZZ

618801 AGTGGAAAGT TCTCAATTTC ACTGAACATT AATAATTATA TATATTTTTG
618851 ATGCTATTTA TACTATTTGA GTGTACATTG TTTTGAAAGT ACTGACATTG
618901 AGAAAACTCA ATCTGTTATT TTACAAAGTC AAACTACCTT TGTATTGTTC
618951 ATATAAAGAT GATTTTAATT CAACTCAATA AATATTACCT TGAGCTCCTA
619001 CCATGCACAA GATCTGGGAC TGAGCATGTC AAGGAGAATA AGACATACAC
619051 AACTCATTCC TTATGCTTAA GAGTTCACAG CCTAGTGAGA AAGACGAATG
619101 TATAAGCTAA AAGTCACCAG CTGGCAGCCC ACAGGCTAAA ATCATCCAAG
619151 AGATGTATTT TATTTGATAT CTGCAGTGTT TTTAAAAAAC ATTTGAGTTC
619201 ATTGCTATTA GTCAGAGCTT TCACCTTTCA GTACAACAGA ATCGCTTTGT
619251 CATCAACTGG ATATAATCAC TTATTGCACC CAATGGACCC TTCAAGGCAT
619301 TTGAGTTTGG TACCATGAAA TTGTAGACAC ACAAATATTG CCACTATGAT
619351 TGACTTCTGC CTGTATTATA ATACCTAAAA TTATATGGAA GAACAGAGAA
619401 GAGAATAGCA AGTAAGTTCT CTCCAGCTAT GTCAAGCACG TTTTGACATG
619451 GGAGATGATA CCTGCCAAAA CCAGAAGGGA CTTCCAGACA GAGGAAAGAT
619501 CATGAAGGCA TGGAGACATG AAATGGTCTC CATGAAGGAG AAGGAGGAAA
619551 ATATTTATCC CCATGTATTG AACATTTATT GCCAACCGCT AATAGGCAGT
619601 CCTCATGTGA TTCATGATAA ACCAATATGT TTATTATTAG CTCCACTTTT
619651 CAAATGAGAA AACTGAATGA AAGAGAAGAT AAATAACTTA TCCAAGATTA
619701 ATCAGTTAGT GAATGGTAGA GTCAGAATTC AAAGTTCTGC CTGACCTCAA
619751 ACCTAGACAT TTTTATTACT AAACATGATG GACGTATTAG CAGATTGTAG
619801 ATTTATTCAG GACACTTTTT CAGTAATTAA GAGTCCAAGT TCCACTGAAT
619851 ATAAGCAGAG GCAAAACCAC TGGTCCCAGC CTCCACTTAG GGAAAATACA
619901 TGCTTCATTC AGTGTAGCGA ATGGAATAAA AATTATGTAA ATAGACTTTT
619951 AGAGCTTAAA GGAAACTTAG GAAAGTTACA GTCCACGTTC AGCATTTTGC
620001 AGGTGAGAAA ATTCAGGCAT TTAAAATATT TGCTTTTAAA AAGTCGAAGA
620051 ACTTCTATTT TAAATACAAA TTAAAACCTA CCTTTCAATA TGTCTTAGTC
620101 TTAATCAACT CCAAAATATT TTAATTCTCC TTGCTAGTGC TATAGTTTTA
620151 AAATATAATT TACAGCAACC ATAATTTTGT GATACGCGTT CTACAAGTCC
620201 AAAGTTTTAA AAATAACTCA GGGAAAAAAT GAACATTTAT TTGTAAAAGC
620251 ACTAAAGAAA TACCTCATAA AAATCTAGCC ATGAAACTGC ACTTTTTGCT
620301 TCAATACATT TATTGTGTCC TATTTAACAA GGGGATGAAA TATCTATAGG
620351 ATTCATATTA CAGTTACCTG AAGGATTTTT TTAAGTTAAA AATAAAACAG
620401 TAATGGTCAT ATTATTTTTA ATTGTATTTA GTGCTGAACA CTGTGGGTTG
620451 GGGTTAGTGT GCAGGTAAAG AGGAAAATAC TAATTTAGTT GTAGGGGCAT
620501 GTCAAGTTAC AAGAATTTAG ATAATGGACA AAGTTATGTG ATTGCATCTT
620551 TGGATTAGTT TAGTCAGACT CAGTCCCTGA AAATAATATT GTCATATCAA
620601 AAATTATTTG ATTTTCTATT TTTGTATTAA AAATGTATGT CATAGGTTAA
620651 AAAATAGATG TGGCAATAAA TATTTATGGA ATAAATTAAG TCAGTGAATG
620701 GATAAAAGCA TAAATTAGTA AGTTATTCAT GAATAGTTAT ATTTTCCCAT
620751 TCTAAGCCAA ATTGAAAATT AGCTCCCTTC CAGCTATAGA AAGTTGCTCT
620801 TGGCCTAGGA AGCAATTGAG CAGGCAGAGT ACTTCCTTAG ATCCTAGCAA
620851 AATATTTGCT TAAGTAATTT GTCACTTTTC ATTTGATCAT TTTTGTATCC
620901 ACTCACTCAA CTTGCATTTA TTGAAACCCA GATCTGTGCA TCTTCTGGTC
620951 ACATTAGAGG AGACCACAGC GAACTCCCAG CCATCCCACC TCATGCATCA
621001 CAATGAGGCA GTAATAATCC TTTCTTTACC AAAGTAGGCA GAGCAGCGTA
621051 GTCTGCCCAA GACTGCATGT TTTCAGTTAA GGATACGCGA AATAAAGATC
621101 TCCATGGAGT AAAAGATGCA TTTTTCCAAT GCTTTACATT AAATGTTTCT
621151 TATTGTCATT GGTCTTCCTC ACTGGTGACA TAAACTTATT GAATCTCTAG
621201 CCTCATCCAC CATCACAGAA AACAAAGAAG TATTTGCTCA AACAAAAGAG
621251 GTTTATGGTC TTACTTCTGT TAGTGAAGGA AATAATGTAT AATGTTATAA
621301 ATTACTATAA CTAAAAAAAA AAGAGAGAGG CATGTAGGAA ACAAAATATG
621351 AGTTACACAA GGAATGGAGG GAAATACACA GTCTGACAAA GTAAGGATAA
621401 ATGAAATTAG ATAGGAGACA GAAGATAGAA AGATGGTAGG TAGGTCAGTA
621451 CTTAGATAGA TGGATGGATA GATGATGGAT GGATGGATGG ATGGATAGAC
621501 AGACAGACAG ACAGACAGAC AGATAAGGTT TGAAGTTTCA GGAATGAGCC
621551 TTCTTCAGGG AAAGTAGCCC TTGGCATTGC ATTAGGTTCA ATAGACTAGT
621601 TTATCTTTGC GCTTTGAAGT TATTCTTACT GTAGCTCAGA GGTACCAGAG
621651 TTCATCCAAA ACCAGTAAGG GAATGGCTAC TATGTGCCAG TTACAGAACT
621701 CAATACTGGA TACTCAAGTA TAAAGAAAGG GCAGGGTGTG GTGGCACATG
621751 CCTGCAATCC CAGCACTTTG GAAAGCCGAG GTGGGCGGAT CACCTGAGGT
621801 CAGGAGTTGG AGACCAGCCT GGCCAACATA GTAAAACCCT GTCTCTACTA
621851 AAAATACAAA AATTAGCCGG ACATGGCGGC GGGCACCTGT AATCCCAGCT
621901 ACTCGGGAGG CTGAGGCAGG AGAATCGCTT GAACCCGGGA GGCAGAATGG
621951 CAGAATCCAG TGAGCCAAGA TCACCCCTTA GCCTGGGCAA CAGAATGAGA
622001 CTCCGTCTCA AAAAAAAAAA AAGAAACTAT CTTACTTCTG AATGCAGACA
622051 CTCTATTCTC AGCTCTTCAA ATTATTGTTC ATGTTCCTAT CATTAAATAT
622101 TTTGGGCCCA AACTCTCCAC TGTATAAATA CTCATTTGTA AATCATATAT
622151 ATGTTCTGCC TTACTTATTA TTGTTTTATG CTTATTATAA AACATACAAA

FIGURE 3AAAAAAAA

622201 ATATAAAATA AGGACAAAAT AAAAATATTT CAAAATAATA TTCACTTTAC
622251 ATATTATTGG TACAAAATTT AACAATTTAG GTCTGACTGG AAGTTCATTT
622301 TATTTCAATA TTTGATTTCA CGTAATAATC ACACTACAAA CAGGCACAAC
622351 ATACATAAAA TGCTACATAT TTATGGCCAG GTTTGCTATG ATATGGGTGG
622401 AATCTGTACT TTCAATAGTG CTCCTGGTGG TTTTTTGTGG CCTCCTCTTT
622451 TTAGATACCA TCCTTATTTT CATAATGTGG TTGGTGAATA ACACATTTTA
622501 GGAGTTGAAG AAATTGATTT TCCATATTCT ATTTGCTTAC TTGGGCCTTT
622551 ATTATGAATT TTCTAATGAA TATCCAAGGT TGGACACCAC TATGTAAGAA
622601 ACAACATGGT CTTCTAGGAT CACTGTGTTG GGCCAGGTAA AATTAAAGCT
622651 TTGCCCTGAT TGTTCAAGCC CTTGAAGTAA ATTATTTACT TCATTCTTAC
622701 TTTGGCATTT TTCTCACTGT TTTATTACTT AGATAAGTGA TCACCAAAAT
622751 TCTCTGATCA CACACATCTA ACAATAAAAA TGTTTGAGCA AGTTTTACAG
622801 GGGATATTAT CAGTATATTT TATTTATAAT TTATTTGTAT CAACTAGTAT
622851 GATATTGTAT ATATTTATAA AAAAATAAAC ATAGCAATTA CTAAAGGATG
622901 AGGAAAAGCA TAAATATAAA TGGAATTTTC AGTATTTTCT TTCTACCGCC
622951 CATCTTCCAT GCACTCTGTT GGTATACCCC CCTGCCCAAT TTTGGAAAAC
623001 ACTAGTATGA AGTAAACTTA TTACTGAACA AGGTGTAACA GAAGAGGACC
623051 AAACACAGTA ACAAGTAATC TTCCTGCACC ACGTCAAACA CATATGTGTG
623101 CATGTATTTC AAATTTCCAA TTCTAAATTT TCTGTCTTTT ATTAAGTCAG
623151 TGTATCTATT GTCTACTTAT AGATCTTAAT GTGTATTTGC AAAAATGCAA
623201 CCTAATGAAA ACAATTTGAA GAAGTCATAT CTCATTTATA TTACAGAGAT
623251 ATTATCCTTA CTATTAAACT TTTTGCCATC AAAAGTAAAT TATTAACATG
623301 TCATCTTCAA AGAAGGGAAT CTTTTCTATG AGGAGTTTGT ATATGTATGT
623351 GGGGGAATCT GCATTAGGAA ATTTTATCAA TTTATTTCAA TTTTATGCTT
623401 AAAGGCTTAT TTTTAAAGAA ACACTAAGAC TGCTAAATAA TAGCAATGGT
623451 TTATATTTAT AATCATTTGC TACATTTAAT TCTCATGAAC AGCCCACTAG
623501 AGTCAGTTAT AATTTTCAAT TTACAGATGA TGAAATTGAA GCACAGTTTA
623551 AGCTCATTGT TAGTCTGTTA TCTTTTACAC AAATGTTTTT TGACAATTTG
623601 CCTTCAGAGC TGATTTGTTA AGCACATGTG AAAATTTCTT TCCTTTTTTA
623651 TAATTTCAAC TTTTATTTTA GATTAAGGAA TACATGTGCG GGTTTGTTAC
623701 ATATGCAAAT GTTTAATGAT CCTTAATTTA CAACATAGAG ATATTTAAGG
623751 GAGATTGCTA CAATATCAAA TTTAAAAAGA TATTTTGTTT CCCAGAGTTT
623801 AAGTCAAGCT TGTCCAACCT GTGGCCTGGG AGCCTCATGT GGCCCAGGAT
623851 GGCTTTGAAT GTGACCCAAC ACAAGTTCCT AAAGTTTCTT AAAATATTAT
623901 GAGGTTGTAT TGCGATTTTT TCTTTTCTTC TCTTTTTTTT TTTTAGCTCA
623951 TGATCTCTCG TTAGTGTTAG TGTATTTTAT GTGTGGCCCA AGACAATTCT
624001 TCTTCTAATG TGCCCCATAG TAGCCAAAAG ATTGGACACC CCTTGTTACG
624051 GATTAAATAT ATATTTTTTA GGATGATTTG AAAACTGATT ATGCTGTAGG
624101 GGCCAGTTTA CTGTAATCAG AATGCTTCCT CAGTTGATCA AGCCAGAAGG
624151 AAGCATGCAG GCCATGTCAG CTTCTGCTTT TTTCCCACTG TCTCGTTACA
624201 TGACCTATTA ACTAGCAACT TTTTAAGATA ATAATAATAA TAATTCTTTA
624251 CTAACGTACA GTATTTCTCA GTGGGTACTA CTAGCATTTT GAGAAATAAT
624301 TTTTTTTCAG AGATTATACA ACTTATTTCA ACAACTTTAG TCTTCCACTC
624351 ACTAAATACT AGGAATGCCT TTCCTCAGTC CTAATTTGCG ACTCTCCCTA
624401 CTGGGAAAGT TATCATGAAA GTGGAGAACC ACTGCACTAA GGAGAGAATC
624451 GAAATCAGAG TTTTAGAATA TTGTATGTGA AATGACACAT TTTGTATCTT
624501 GAACTTGTAA CGGCTAGAGG AATACTCTTA TTACATATAA AATCTAATTT
624551 ATATTAACAA ATACTCCACG GAATGTAACT AAAAACAAAA TATTCGTGGA
624601 AGCAGATATT GCTCCTGCTA CACATTTTAG ATTTCATTTA CTTTTTAGCT
624651 ACAATATCAT TGAATAATAA ATTCCACAAT TAATTGAAAG AAAACAGACA
624701 GACAGAGTTA GCAACTTAAG CAATTGGGAA AGCCAGACTA AAACTAATTT
624751 ATATCAAACC CCAAAACTTA ACACCTAGTG GATGAAGAAA CAAGGAAATT
624801 ATAACAAAGA ATTGCTGTTT CTCCTGAATA AATTGTGAAA GCTTACTTTA
624851 GTGTTTCATG CAATCTCTGT TGATATAACT GACCTTAAGG AGAAAAATGA
624901 TAAGGCATTA CTATCACGTA ATATCTCACC TGAATATATA TTCATGTACA
624951 CCAGTCCTTC TATTTTGTTT GTCTGTTTTT TCAGCTGTGA AAAATGACAG
625001 TTCCTTAAGG AAGAGATGCC ACAATAGATG AAAGACCTTT TTACCCATGG
625051 TAAAGAAACA TAGCAGAGAC ATTATGAATG ATGCAGGAAG CTTAGGAAAA
625101 TGAAAGCTGC TATTAACTAT GACAGGCTGT CACAACAACA AAAACAGTAA
625151 TCAATGCAAT CATAGCAATA AGATAATATT TGTATTAGTT TCTTTCAAAA
625201 AGTTAAAATA ATGGGTATCT TTTATGAGTT GACAGTTTGG ATAATGTTGG
625251 CAAAAACAGG AAAAACTCAG ATAAAAATCT CAATGTGTAA CATATTAACA
625301 TTATCTAGAG TCACTACTTT ACATATTTTT GTTTTTCTTC AAATTGCCTT
625351 TAATTTCATT TATATCATTT TTTCTTTGCT CTTCATGACT ATGTTATTAT
625401 GTTTCTTTAT GATCTAATAT TCTTGAACTG AGTTTCCTAT TACTTGGCTT
625451 CAATAAATCC ATAATCAGCT AAAATTGCAT TATTTTAGCT TTTCACAGCA
625501 TATAATAAAA TCTGCATTTG TTGTCATTAT TTTCCCTATT GTAACAATAT
625551 CATTACTCTT GCAACTTTAA GTAAGACTGC TGTATAAATA TATGATCACC

FIGURE 3BBBBBBBB

625601 CCACTTGGTA TTCAATGATG CACCTTCATT ACAAGTGTTA TCTCAGAAAA
625651 TGATGAAACA TTGCAATGTG GAAAATGCCT TGTGTGGGAA ACATTGCACA
625701 CAGACACATA TTAACTTTGT GTTCAATGAT AGATATTCCA TGCATTCACA
625751 AGGAAGTTTG TTGCACTACT CCTTGTAAGT TACCTCGGAG TACTTTCTGA
625801 CTTACCACTT GGCATTCTTG CCCTGTCTCT TAATGTTTAA GGGACTCCAG
625851 CTCTTCATGA CAGAACCCTA CACTAAGGCC CCATAAAATC AACAACAAAA
625901 CTAGTTTATT CACTGTATTT AATTTTTTTT CTAAGCTTTC TTTAATCCAG
625951 TGCACACTGT ATTGGCCTCA CCTGTTAAAA TACACATTGT AACTTTGCTC
626001 TTTCATGAAA ACATTTCTAA AGATCTGAGA GATGTGAACT TTTCTTTACC
626051 AATAACGTTC TCCATGGAAA CAAGATATAT ATAGTGTGCC CAGTTCCTTT
626101 AATTCTGACC CAAGTTCAAA GAAGCCTCAA ATTTTAACTT ATTTTTGGTG
626151 GAGAATTTGT GTCAAGATAC AAAGTGAGGT CTCTTCGCAA ACACAGAACT
626201 TGCTAAATCT GAGCATGAAA GGAAAGACCC CAGGATTCAA AATGTGAAGC
626251 TATGCAGCCT GAGGCATTTC AGAGTGGCTG AACGAAATAC AGTCCTTACA
626301 ATCATCAGTG TAACTTGTTT TGTTTTGTTT TGTTGGTGGG TGGGGGAGGG
626351 TTCTAGTGCA ATTTTTGCCT TTGATTGGCC GTATCAGTTA CCAGTGATGC
626401 CCATTCACTA ATACTGCAAG TGTATTAAAT TTTCATCTGA GTGAGTTTAG
626451 GATCTTAAAG TTATTAAGAC ACCAAATTAT GATGTTACTA TTCCAAAGTG
626501 CAGAGTTTCT AACTCATATT CAGAGGATAG CAATCTCCCA AATAAGAATG
626551 TATTCGTGAT TTATTTTTAT TCTAGTGTGG GAAGAGTTTG TCCTGGTAGT
626601 CTACCAACCA CGTGGCAGTG ACTCCCCTCC TTAGGTCTCA GTTTGTTGGT
626651 CTAAAATGAG TGGTTTTAAC TAGATGATCT CTACACTGTT ATTTCGTTCT
626701 GACACTCTTT TATTCTATGA TTCATTATAT AATTTTATGG ATAAATTTCC
626751 AAGCCACTTA CTTTTTCTTT ACAATATCCT TCTTAAAAAT GAAAAAGCAT
626801 GTGGTTTTAC CTTTGCAAAC TCTCATGTCT TGTCCCTAAT GGAAAAGTAT
626851 AACAAATTAA TAATTGTGTA CATCAATTTT CTTGTCCCTG TTGCAAAAAT
626901 ATGTAATTAC TGCATGATGT AAAAGTTTTC CTTATTTTAA GCACTAATAG
626951 AGATAGACCT AAAGTAAAGT ACTGCTCCTG TTGTTATAGC ATATATCAGA
627001 TCTTATCGTG GCTATTTTCT GCATGCCTGT AACTCATGTA GGCATGAATT
627051 CTGCAAATAA ACAACATCAA TGACTAGCAT TTATATCCAT TTTATTATTC
627101 CATGCACAGC TTTATGTTCT AAATGTAGGT TTGGAAATTG TATCTAGCAC
627151 TCTGATGCTT CTAACCCTCT TTAATTGTAA CTAGTTGAGT AGCTTTCTTT
627201 TCAAGAAACT AAGTTGATTT TATAAATTTA TGGAGTAAAA AATGCATTCC
627251 ATCCCTTTAA TTTTATAACT TCTTCGTAAA ATTTGATGTC TTTGTTGATT
627301 TTAGGTTTTA TTCCATGTAA ATGATCAATG CTTTTCCATA AAGAAGACTT
627351 TGATTAATGT CAATTTTTAT CTCTTAAAAG GATCCTTCCC GGCCATTGGG
627401 GTGGAGGCGT TTTGCCCCAG CTTCCTGAGG GCAGGGTTTT TAAATAGCAT
627451 CCAGGCCCCG CATCCAGTGC CAGGGGGAGG ATCTTTGCCC CCCAGGATTC
627501 CTGCTGGTAG GTATTTCAGG TGAAGTTTTC TGCCACCATA TACAGCAGTA
627551 GGATTGTGCT CATAGTTGAT AGGCCCCAAA TACAAAATGA ATATTGCTTA
627601 AATATATTGT GGAAAAGAAA TGTAAGTGAC TGCTTAAATT CAGAAACCAT
627651 ATTTATAATA CTGAATGCTG TCAAAATGGC ACAAAGGAAG TGAAAGGACT
627701 CTGCGCACCT AATTCGCATA GTGCTGCCTC CTCTCCTGAG AAAATTTTTA
627751 CTTAAGTAAG AATTAGAGCT TCAGATCCAA AATATGTAAC TCAAGAATAA
627801 ACAAAGATGG ACTTCAGACA CTTTGCCACT TGGAATTGGC CAGAAAAGTG
627851 AATTAAAAAC TAAGTGTTCT TGGCAGAAAG AGTAATTTCA TAGAGTTGAT
627901 AGAGAATTAA AGTATCCTTT CATTACAGAA AAAAAAATGA TTTGAAGAAA
627951 CCAGAAAGTA GCAACCTGAA AGACATATTT TAGAATAAAA ATTAATATGC
628001 ATTTTTCCCT AAAAATGCCA ATCTGACCAA AGCCATATTT TATTGAGAGA
628051 AACAAAATAT AGGATATTGA ACATTTAAAA ATGCAATTTC AAATTTACTA
628101 AAACACTTTG CAGGTTATCC ATGGCATGAT TGTAATTACA ATTTGTTTCT
628151 TCCCTGACAT TTAGTAAAAT ATCCAGCTGC CTTCCTTCAT TGTACCTAAA
628201 GGATGCAATC TTACTTTACA TTTTATATGT GTCTTAGCAA AACAGAATTC
628251 AAATATTGAT TCTTGGAGTT TTGAAATCAT AATTCTTGTG ATTTTTATTA
628301 TAACTAATAA TAATGCTAAA AAATTATTGT TATGACATCA ATGTATTCAG
628351 GAGAGCTGGC CCAGCCTGCA ATGTAATGGG AACACTTCAA AAGACTGGGA
628401 AATCCAATAA AAACAAAAAT CCCAGCAATG TACATTTCTT GTCCTTGTTA
628451 GCATAATTAT ACCAACAAAT CTTAAGACTA TTCTACACTG ATATTTTTCC
628501 TTTGCTTTTC AATTACTCTT TTCTACTTAA TTGAAACATA TAAATATGCT
628551 TTGAAGTCAT TTAGCTTCAT CACTGGATAA TTTATTGATG TGGTTAGATA
628601 CTTTGTGGCC AAGAATACCA CTGAAAGAGC AGAAACCAAA ATTACACGAG
628651 TTAAAAGATT GTAAATTTTC ACTTTATTGG GTGTTATATA GCCCTTTTTC
628701 TCCTTAGAGA AAGAAATGAT ACCAATTGTA CAGAAATTTT GTTGTTGATG
628751 ATGTTGTTGC AAAGGATTAG AAAGAAAAAC TATATAAGCC AAGCTCTCCG
628801 AGTTAACTGC AAATATAAAC ATGTAGCTTT CATGTATAAT TAATATCCCA
628851 GTGATTGGAA TTTAGAAGAT GAGCAGATTG TGTAGAGTTT AATGGCCTCA
628901 CCCTTAACTC TTAATGACAA ATCTTGGTCA AGTCAGATAT GTTTGGCAGA
628951 AATAACATTA TGAAGTTTAA GACTGACTTG AATTATTCAA CATCACTGTT

FIGURE 3CCCCCCCC

```
629001 AGAAAACAAA AAACCTTTGT CATTTAGCTA CTGAGAATGA CAGAAGGAAG
629051 ATGATTGTTC TATAACACAT ACAGAAACAA CTTTCCAGAG AGGGATCTAA
629101 AAGAACATTC TAGCACTCTA TTCTTCTAGG CTTTAAGCCA AATTTGCCTC
629151 AAGCTTTCAT AGGAGAGAAA ACTCAGTTCA GTTTTCATGA CTTACATACA
629201 AATCAGGTGT AAAAAAATTG CTTCTTAAAA AATGTATAGA TCTAAACTTG
629251 TCCCTGTTTC CACAAACTGA AATTAACTCA ACACACTTTT CCTGGCTTAT
629301 ATCATTTTGA TAAGTCATCT CTGTACATTT TGTGTGATAC TTTTTGGTAA
629351 TGACTGCTAC TATTTCAAAG AATTTTTTTA TCCTTTCTTG TTCAACTATA
629401 GCTTATTTCC CAAGATTTTT TTTATATTTT GTGTAAAGAG GAATGAAGCA
629451 GTAATCATGA GAAGTTTTTA TTATTTTATA TTTTTTAAAA AAACTAAAGT
629501 ATTTCTTTGC CATCTAATAG CTGAATTAAT ACCCTTCAGA TTTCAGACAT
629551 CAATTTGAGG GCAGCAAGTG TTTTCTCCCA TGGCCCATAC TATGACACTT
629601 TAAACACTCA GCTGAAGGTT GATGCCCACT GGGCAGCAGT AAACTCACTT
629651 TCTGCCAATT GATTATCGGT CACAGTATTT TAAGGGTCAC ATAAGACATT
629701 TTCTGTATCA GTCAAGAAAT TTAAAAACCT GTTCTATTGC TAATTTAGTT
629751 CTCAATTACT TATCATAATC AAATTTAAAA GAGATACGTG ACTATGTCTT
629801 ATATATAATA GTTTGTGCTT CACGTCACAC TGTGCTATTA AAAAGCAGTA
629851 TTTCTATAGT ACTTACTTTT ACAGTAACTA TCATAATCAC AGATTCATTG
629901 AATCATGAGA CCTAGAAAGC AGACAAGCCT GAAATTAGTA TTTATGCAAC
629951 AGTTGTCAAC TGTTTATGTT TCTCATTTCT AAAAAGGTCA TAGTAAAGGG
630001 TTATTATTCT TAGTTTCAGA TGGAGAAAAA CACCAGGAAG TATTAGCTGA
630051 AAATTGAATA GCAAGTTTAT CAATACGATT AACAGAATGC ATTTGTGTAG
630101 TAGTCACCGA TACAGGAAGA AATCACAGAA GGCCAGGCGC GGTGGCTCAG
630151 GCCTGTAATC CCAGCACTTT GGGAGGCCAA GGCAGGTAGA TCACCTGAGG
630201 TCAGGAGTTA GAGACCAGCC TGGCCAACAT GGTGAGTCGC CATCTCTACT
630251 AAAAATACAA AAAATTAGCT GGGCATGGTG GCGGGCACCT GTAATCTCAG
630301 CTACTTGGGA GGCTGAGGCA GAGGAATTGC TTTATCCCGG TACGTGGAAG
630351 TTGCAGTGAG CCGAGATGGT GCCACTGCAC TCCAGCCTGG GCAATAAAAG
630401 CGAAACTTCA TCTCAAAAAA GAAAAAAAAG GAAATCACAG GAGAGAAGAG
630451 GAGAGGAGAG GAGAGGAGAG GAAGCGAAGG AGAAAAGAGA GGGGAGAATA
630501 AACGAAAGAA GAGAATGGGG AAGGAGAAGA GAAATTAGAA ATGACGTAAC
630551 TCTAAAATTT TATTTTTTAA AGGAAAGTCT TCCTCCACTA TATTTATTAC
630601 TGTTTAAATC AAATTCTACC ACCTTGAAAA GAATGTGTCC CTCTTTTAAA
630651 TATGTTATCA GACATATTCT CTTTTTTTTT TTTTTTTTTT TTGAGACGGA
630701 GTCTCTCTCT GTCGCCCAGG CTGGAGTGCA GTGGCACGAT CTCGGCTCAC
630751 TGCAAGCTTC GCCTCCCGGG TTCACGCCAT TCTCCTGCCT CAGCCTCACG
630801 AGTAGCTGGG ACTACAGGCG CCCGCCACCG CTCCCGGCTA ATTTTTTGTA
630851 TTTTTAGTAG AGGCGGGGTT TCACTGTGTT AGCCAGGATG GTCTCGATCT
630901 ACTGACCTCA TGATCCGCCC GCCTCTGCCT CCCAAAGTGC TGGGATTACA
630951 GGCGTGAGCC ACCGCGCCCG GCCATATCAG ACATAGTCTC TAAAATAATA
631001 AGCTTGCTCT CTTTGCTCCA TGTAGTTATT TCTTTAACTT AATTATGTTG
631051 TCAAACAGTA TTTGAAAGTG GTTTAGAATT TTTTATATGC CATAGAGTAT
631101 TGAGTATACA TAGTCTTAGA CTAGTGGATC ACATTATGAC AGATTTCACC
631151 TCTACTCAAA TCCTCTATAT TTTTGGCAGT TTGATGTTTG CCATACACAA
631201 ACGATAGGAG AATAATAAAG CATTAAAAAT AAAATTCTAC ATTAATAGTG
631251 ATGGAGTAAC ATATAGAAAT TTCATGAATT CACTTTCTCT GTCACTTCTC
631301 AGCAATAACT ATCTGACATC ATATGGTATC TTAAATCTAC ATAAAATGCA
631351 ACCATTACAA TGTGTCTCAA AAATTAGACC AACCTATAAG ATGTAAAGGC
631401 ATGTTTATTA TCTGCTAATT ACTCAGCAAA TCATATCTTA AGGGTGAATG
631451 TGTTCATATC TACAAAATTT TAGCTTACTT TTTTGTCCCT TTTCTATCAG
631501 TTGTGAGACT TGATAATATT TTTTACTAAT GAAGTAACTC ATATACATAT
631551 ATATATATAT ATATATATAT ANNNNNNNNN NNNNNNNNNN NNNNNNNNNN
631601 NNNNNNNNNN NNNNNNNNNN NGACACTCTC ATATCTGTTG TTGCTGTTTA
631651 ATTGGTTTAT CCGGGGATGT GGATGCATGA CAAATATAGT TGTGTGAAAG
631701 GAGTGTTGAA TACGTGCGGG GAATATGATG CGTCTATATA TCCTGTTGTT
631751 GCAATACAGC GGGGGTTTTA ATGATTTCTG ATTTACTTGA GAGGTAGGTC
631801 GATGGATATA TCGGGGTATG CGAGGGCGCG TAATTAGGGG GAGGGCGAGT
631851 TAAATTGGCT ATGTAGTGCG CGCGGGGTAT TTAAGCTGTA TTATGGCATA
631901 TACGTACAAA ATGTAACACG AGAGGGACGG CCAGGTACTA GAGGTGTAGC
631951 GCTAAATGGG GGAAGGTAAA AAAGGAAGGG AGCCATATGC AGGGATGTAT
632001 ATAGATAAAC ATATAGATGT AGGGGTAGGA TAGCTCGAGG AGAACTTTGC
632051 GCGTGGACGA GCGCGATTCG CATATGAATG TATGGAATGT ATATAGATAT
632101 ATGAATATAT ATATATGTGT GTAGTGATGC CAGACTGGAT TATAGATATA
632151 TAGACATATA TACAGAGAGA TAGTTAAATA TGGAATATAT ATATATGGAA
632201 TAGAGTGGGT AGCCAAACTC AAATATATCT TAAACTAACA AGTTTAAGAT
632251 ATCAATTATA AGAGAAGTCT ATGAAAGAGA GAACTAGGAA ACAGGCAGCA
632301 TGTGGGACTT GGAAATAGAC AAGCTGTGAG GGAATAAAAT CAGTGTTGAA
632351 TATCTCCCTA ATATTTCCTT TGTGGTTAAT CGTAGAAGCT CTTTAGTTAT
```

FIGURE 3DDDDDDDD

632401 TGAAGGAATA TTCTTCTGAG GTACCCTCTC TGTTTGCCTG CCTGTGCTTT
632451 AAGTACAATG CTATATGTAT AATACCTCTT TTGACATTTT TACCTGAGCT
632501 TCTCTCCATT CTATGACTTG TGTTAGGTTC AAAGGAAATG GCAAAGATAG
632551 CGTGAGACTT CCTGTCTGCT GCTCTGAATC AAATAACAGG AGAATTATGA
632601 ACACATGGGT ATTCAAAAAC TATATTTGCG ATTACTGAGT ATATAATTAA
632651 GAATAATGTT TAATATTGTT TATTTATTTA TCCTTTGGAA AGAGATTTGG
632701 ATGAGCCTTA TACTCAAATA CCAAGCATTT TGACATCCTC ACTGCTATTC
632751 TCTGAGTAGC CATGTTAGAA AATGGTTTAA CAACCCAGAT TTCTATAAAC
632801 CACATATCCA ATAATGTCAT TTCTATAGCA AAGGACATAC AGTCCTCAGC
632851 CAACATTAAA ATGTCTTTAC AGTACACTAA CAATGTTTAT CAATATTTTC
632901 CTTTCCACAT TTCATGTGAA ATCTTGTCTG GGCTGAAGTC AGGGAAAATA
632951 TTGTATTCAC TATTATACAG TCAAAAATAT TTTTATTCAG AAAGTATATG
633001 GCTTAGATGT TACAAATGGA ATGTAAGTAA GCCAGGAATG ATAAATAAAT
633051 TTGAAGCTCT AGAAAATCTA GGATCTGGTG GATATAATAT TATCAAGTTT
633101 TGATGCATAT AGAGGACTGT AGAAAAGTAG TAATGCAAAT ATATAAGACT
633151 AGGTGGCAGA CTTTGGAGAA ATGTACACTA AGCTAAGGAA AATTGGCATA
633201 AACTCAATAT GCCAAGGAAA GTCAACAGTG GAAAAGTATA TGCATTTTAA
633251 ATATGATCAA ATTGCACTTC AGAAAAATCA AAGTAGATCA TTTTATTTCT
633301 TCATATTTTC AGACATTCTT TAAAAAGTTA GTACCCATTT TTATTTTTTA
633351 TTTTTTTTAT TTTTTATTTA TTTATTTTTT TTGGAGACAC CTGTTTGTTT
633401 ATTTTTGCCA CTAATCATTA TACGTTATTT AAAAACAAGA GATGATTAAA
633451 TCCATCTTTC AGGTCATTTA GTTAAGTTTT TTTTTTATTA TTATACTTTA
633501 AGTTTTAGGG TACATGTGCA CATTGTGCAG GTTAATTACA TATGTATACA
633551 TGTGCCATGC TGGTGCGCTG CACCCACTAA CTCGTCATCT AGCATTAGGT
633601 ATATCTCCCA ATGCTATCCC TCCCCCCTCC CCCCACCCCA CCACAGTCCC
633651 CAGAGTGTGA TATTCCCCTT CCTGTGTCCA TGTGATCTCA TTGTTCAATT
633701 CCCACCTATG AGTGAGAATA TGCGGTGTTT GGTTTTTTGT TCTTGTGATA
633751 GTTTACTGAG AATGATGATT TCCAATTTCA TCCATGTCCC TACAAAGGAC
633801 ATGAACTCAT CAATTTTTCT GGCTGCATAG TATTCCATGG TGTATATGTG
633851 CCACATTTTC TTAATCCAGT CTATCATTGT TGGACATTTG GGTTGGTTCC
633901 GAGTCTTTGC TATTGTGAAT AATGCCGCAA TAAACATACG TGTGCATGTG
633951 TCTTTATAGC AGCATGATTT ATAGTCATTT GGGTATATAC CCAGTAATGG
634001 GATGGCTGGG TCAAATGGTA TTTCTAGTTC TAGATCCCTG AAGAATCGCC
634051 ACACTGACTT CCACAATGGT TGAACTAGTT TACAGTCCCA CCAACAGTGT
634101 AAAAGTGTTC CTATTTCTCC ACATCCTCTC CAGCACCTGT TGTTTCCTGA
634151 CTTTTTAATG ATTGCCATTC TAACTGGTGT GAGATGGTAT CTCATTGTGG
634201 TTTTGATTTG CATTTCTCTG ATGACCAGTG ATGATGAGCA TTTTTTCATG
634251 TGTTTTTTGG CTGCATAAAT GTCTTCTTTT GAGAAGTGTC TGTTCATGTC
634301 CTTTGCCCAC TTTTTGATGG GGTTGTTTGA TTTTTTCTTG TAAATTTGTT
634351 TGAGTTCATT GTAGATTCTG GATATTAGCC CTTTGTCAGA CGAGTAGGTT
634401 GCGAAAATTT TCTCCCATTT TGTAGGTTGC CTGTTCACTC TGATGGTAGT
634451 TTCTTTTGCT GTGCAGAAGC TCTTTAGTTT AATTAGATCC CATTTGTCAA
634501 TTTTGTCTTT TGTTGCCATT GCTTTTGGTG TTTTGGACAT GAAATCCTTG
634551 CCCATGCCTA TGTCCTGAAT GGTAATGCCT AGGTTTTCTT CTAGGGTTTT
634601 TATGGTTTTA GGTCTAACGT TTAAATCTTT AATCCATCTT GAATTGATTT
634651 TTGTATAAGG TGTAAGGAAG GGATCCAGTT TCAGCTTTCT ACATATGGCT
634701 AGCCAGTTTT CCCAGCACCA TTTATTAAAT AGGGAATCCT TTCCCCATTT
634751 CTTGTTTTTC TCAGGTTTGT CAAAGATCAG ACAGTTGTAG GTATGCGGCG
634801 TTATTTCTGA GGGCTCTGTT CTGTTCCATT GATCTATATC TCTGTTTTGG
634851 TACCAGTACC ATGCTGTTTT GGTTACTGTA GCCTTGTAGT ATAGTTTGAA
634901 GTCAGATAGT GTGATGCCTC CAGCTTTGTT CTTTTGGCTT AGGATTGACT
634951 TGGTGATGCG GGCTCCTTTT TGGTTCCATA TGAACTTTAA AGTAGTTTTT
635001 TCCAATTCTG TGAAGAAAGT CATTGGTAGC TTGATGGGGA TGGCATTGAA
635051 TCTGTAAATT ACCTTGAGCA GTATGGCCAT GTTCATGATA TTGATTCTTC
635101 CTACCCATGA GCATGGAATG TTCTTCCATT TGTTTGTATC CTCTTTTATT
635151 TCCTTGAGCA GTGGTTTGTA GTTCTCCTTG AAGAGGTCCT TCACATCCCT
635201 TTAAGTTGGA TTCCTAGGTA TTTTATTCTC TTTGAAGCAA TTGTGAATGG
635251 GAGTTCACTC ATGATTTGGC TCTCTGTTTG TCTGTTGTTG GTGTATAAGA
635301 ATGCTTGTGA TTTTTGTACA TTGATTTTGT ATCCTGAGAC TTTGCTGAAG
635351 TTGCTTATCA GCTGAAGGAG ATTTTGGGCT GAGACAATGG GGTTTTCTAG
635401 ATATACAATC ATGTCGTCTG CAAACAGGGA CAATTTGACT TCCTCTTTTC
635451 CTAATTGAAT ACCCTTTATT TCCTTCTCCT GCCTAATTGC CCTGGCCAGA
635501 ACTTCCAACA CTATGTTGAA TAGGAGTGGT GAGAGAGGGC ATCCCTGTCT
635551 TGTGCCTGTT TTCAAAGGGA ATGCTTCCAG TTTTTGCCCA TTCAGTATGA
635601 TATTGGCTGT GGGTTTGTCA TAGATAGCTC TTATTATTTT GAAATACGTC
635651 CCATCAATAC CTAATTTATT GAGAGTTTTT AGCATGAAGG GTTGTTGAAT
635701 TTTGTCAAAG GCTTTTTCTG CTTTGTTTCT TGGCCAAAAA TAAGACTCCT
635751 CATTATAAAC CAGGTGAAAA CTCAGCCATT ATTTAACCTT CCTCCCCAAC

FIGURE 3EEEEEEEE

635801 CCTGATTTTG AAAAGCCAAG GCTCTACTCT CTTCCCCAAG AAAATGGACA
635851 TGTGATCATG TATGTAAGTG TTTACATACA ATTTTAGGAA GTCTCTGGAC
635901 ATCCTAAAGT TTGCACACAA AGAACCCCTG GTTCTAAAGA ATTCAATGTT
635951 CTATATATAA AGTTATGCTG AACTGACATA AGTGAGCATC ATCTTTATGT
636001 AAGACTAGCA GTGCATTAAA AAAAAAAAGC TACGTGATGC ATTTGATATC
636051 AAGCTCTTGA GCATTACAAA GAGAATTTCT ATTTTTCTCC TTCCAGAAAG
636101 ACATGAAAAA TCTTAAAAGA GCCTTTAAGT AATCTCTAGA TTTTTTTAGT
636151 AGTTCTTTTT TACTTCTCTA TTTTCAGAAT TTTTAAATAG TTCTAGCCTT
636201 TGGCCTTAAC TAAGCCTTCT TATTAGCATA AATGTTTCTT TTATCTTAAT
636251 GTCATTTGAA TAAGTTTGAA TGTTAAAAAT AAATATGATA TATATATGGC
636301 TATTTAAATT CTCCATTGAG AGCATACCTA CTCCCTAGAT ATCTTCATGT
636351 TTTATTATTA CAGATTGTGC CATTTATTTT GGTCTTATTC AAAGAAACTA
636401 TCAGCACTTT CAAAAGATGC ATTCAAAATC ATTTTCTTCT TACAAAGAAA
636451 AATTCTGAAA ATCTTTCCAT GGCTTGCTAA GTTAGCTGAG TCTTCATGTA
636501 AATCAGTATT TACTATTTGT GCTGATTAGT ATTTTTTTGT AAGGGAGGTT
636551 TCACCTTAAT TGGGAACATA ATAAGAAACT AGGCTGCTCA GCTGTCTATT
636601 CCTCTCCAGA GAGCCATGTT GAGCCGCACA GGATAGCATA CATGCCCTCA
636651 TGGGATGCTG GACCACTTAA AAATATAACT AACATGGAGA CAGACCAGCC
636701 CTGCTGTAAA ACATGTGTTG GCTCAGCCTT CATTGTTTTG CTTTGTAGGA
636751 CAAATCACAG TGGAAGCTGC CCTATGACAC CATGTTGGCT TTTCATATTT
636801 ATGTTCACAG AGGTCTTAAC AGCGAGTGCA TTTATCAAAG CAGAACTTTT
636851 TAAAAATTAA ACATTTGGAA GAGTTGCAGA AAAGATTAAG AAATAAATAG
636901 TTACTTGCCT GGTGCATTGG GGGTGGGGGG AAGGAAAGTA GTCAGTGGTT
636951 TAATTATGTC ATATGTATGA CTATTTAACA AATATTTTTG CCATTATAAT
637001 TAAAATCACT CTGTAAATTA CCTACGTAGT TAGAATACAT GAAATATATT
637051 CTGTTTGGGG TTTATTTTAT TTTTAAATTT TCTGATAATT TTCTTTTGAC
637101 AGTGAATGAT ACAGAAAAGC CGAAAGCAAA ATATTTGAAC ATTTATTTAA
637151 TAATAAGACA TTTTTCAAGC CAGAAGTAAA GCGTAGCATT TGAAATACCA
637201 CTGGAAAATA TGATGCTTTC TACCAAAAGC TTAGAGACTC TCTTAAAATA
637251 TTCAGGATGT AACACTTTCT CTAGTGTCTT CCCCAGAGTT TTTGCAAAAG
637301 CATATAACAT TGCTGCTCTT TAATGTTCTC ATATATGCCT CTTACAACTG
637351 AAATTTCAAC TGCTAAGCCT TGTCTTTTTA AGCCAAATTT GAGAATATTA
637401 ATATAATATA AAACAAATTT ATTTTTAATG GAACCTTAAG ATTATTAATA
637451 TAAACTGATG TTTGAGAAAG CAAAATCTGA AGGTTTTTCC AATCAGTGTC
637501 CTTAGTACAT ATTTCCTGTT TGTATAGAAC GTTTTACAGC TTTGTAGGCC
637551 TTTAAAATCC TGGAATTTCT CAATAAAATA TCCCAGGGAG CAACACAGTG
637601 CCTAGTTCAT AATACCCTTC CAGGATATTT CTAGGATAAG ACACAGAGAT
637651 TTGGGGTAAT GCTTTATGCT CCTCAAATTA CTAGTGGAGA CAAGCTTTAC
637701 TTTGGGGTAT AAGGAGATGG CCAAGCATTC AGACTCTGGA ACCAGATTGC
637751 CTGGCTTTAA GCCCCTGAGC TGCCAATTGC TCACTGTGTG TCCTTAGGCA
637801 AGTTGCTTAA ACTCTCAGTG CATCAGTAAC CTTACCTGTT AAATTGAGCT
637851 AATAATTACA CTTGCCACAA GGGTCAATAT GAGGATTAAA TGAGTTTAAA
637901 CATGTAAAGC TCATAGAACA GTGCCTAGCA CATTGAAGAA CTTATAAAAA
637951 ATTATTCTTA CCTACCTGCT GATTTAGAGT AGTATCTATT TTTAAATTAT
638001 ACAAACAGAT TTTAAAGAAG AAAACCAAGA ACTAAAGCAG CATATAATTA
638051 TTTATTTGAC ATGTAATTTA ATTTAGTTTT GAACTTCGAC ATTATATAGT
638101 ATTTCAAGAT ATGAAAATTC CTTGCTGTGT TTTTTTATTG CTTCCTAATA
638151 GTAATTCAAC TATTAATTAT TACATAACCA CTTCCTTCAT AATTTTGGGG
638201 AAGCAAAAAT CACAAATAAT TTCAAAAGAT ATGCTTTTAA TTTGTATATC
638251 ACCATTACTT TTCTAAATGT GAATGTAATA CAAAATCAAG AAAGACATTC
638301 TTAAAAACTC ATTTGTTATT AAAATTTTTC AATATGGTTA GTATCTTATA
638351 GTAAAAACAA TCCAACATGA GGCAAATTTG TCAGTAACTT TCATTGTTAA
638401 CAAGACACTT TTAGTTAAGA AGAAACCTTT TTTCCTATAT GATAATTTCT
638451 AGCAGGAAGG AGGACATCAC TGAATATTAC TGAGGTCAAC TGATGCAGAT
638501 GGCATGCCAC TGCTCTCTGG AACCGGCAGG AAAATCATGT TTTGTTTCTC
638551 TAGCCTCACA CCTTCCATTT ACTCTAACAA ATCTAGATTA AGAAATGTTA
638601 CTATTTTCAT AAATGCAGAT CACCTTTCCT AATTTTTGCT CAGCTCTTTT
638651 ATCACTAGAG AAAGTATTTT TTCAGCATTT TTCCAAGGGT ATTTGGCTTA
638701 CCACTAAATT TTAAAAAGGA AATGAAATAA ATTAAGGGGG AAAATGGAAT
638751 CGAATCATCA TAGTGACTAT ATAAACTGAG GGTTTTCAAA TCACTCTAAG
638801 ATTAAAACCG TCAATTCTAG ATTAACCATA AAACATGTTA CAGGCAAAAA
638851 TCTGTAAACA GAGTGCAGAA GATACAACAT AGATTGTTAA TGGGAATAAG
638901 AACCTACTTT TAGCAGATGT TATTGTTAAG AAATTATATG TTATAGTATG
638951 TTATTTAAAA TAGGAAAATA CTCATATAAA TTGTTTTACT CTACCCTAAG
639001 AGAAACCATC TTGTTCATTG AAGCAATTTC AAACCTGTCA ATTTCAGGCA
639051 TATATGATTT AAATGGACCT TTGAGACCAT CAGAGAGCTC CTAAATTTAC
639101 TGACACTAGT CATTTTACTA ATGAACCTTA TTAGCTCTGC AAACCACTTC
639151 TTAGCTTAGG ATTCAACATC TAGTCAGTAA GGTAGCATAT AATACTCAAC

FIGURE 3FFFFFFFF

639201 ATATAGCCAT TCATTTAATT AGCTGTTATT GGGTGACTCA ATATTCAGTA
639251 TTTGGTTCTA TTCTCTGTTT TAAACACATT ATCCTTTTCA TCTCACCACC
639301 CTAAGGAGGA GGCTATAATA ATATACCTAT ATATAATAAA ATCAATAATA
639351 AGATACAAAT GAGGAAATTA AATATGCCAA TGAGAAATAT ATAATATTCA
639401 AATGAGGAAA CAGAGACAGT GAGTTGAAAA GTGAGTTAAA AAAGGTTACT
639451 TGTCCAAAGG GGAAAACATC TCCAATATCA GGCTATGTGA CTCTAATCTT
639501 ACAACTTCAA CTGTACTGTG CTGGGTGAGC AAAATATAGA GTAACCAATC
639551 ATCCTAGTTT GCCTGGGACA CAAGAATTTT AGTGCTAAAA CTGGAAGTTT
639601 ACTGCATCAT ATGAAACATC TAACTAGCAA TAATTTTACT TTCACTTAGC
639651 CAAAGATGAA AAAATAATTT TCATGTCAAT ACCAATCTGC AATAAAAAAT
639701 AAAAATTTTC TATTTTTTTA AAACTTTTTG TGACATAGTG TGCAAACATA
639751 ATAATACAGA AGCAGATACC TATGCACAAA AGGAAAGGAA AGTAGATGGA
639801 CATCAACATT TTAGTGACAA ACATTGTGCT AATTATATAT TTTCTCATCC
639851 GATTATTTCA AAAAGTTTAT GTAGAACATG ATATTATTCT CATTTTATAG
639901 ATGCAAAAAC TGAAAGAGCT AAAATAACTT CCCTAAGATC ATGCAACTAC
639951 TAGTTAGAGG AGCTGAAATT TGAATTTTTC TGTCTTCAAA ACAATAGTTT
640001 TGATAATATA ACTAATTTAG GATTAAAAAT TATTGATTTG CCATTCTGTT
640051 ATTTCAGTAA ATCTTTTGTA GGTCTGCAAT TGTTCTTGGA GAACATTCTT
640101 ATGTGTGTGT TTCTTCTGAC ATTCAACTCA AAAAATATGA AATTGAATAC
640151 CTACTCTGTG CCTAGCTCTG TGCTTAGATA GTGACCTTAT AGAGAAGAAT
640201 TGGGCATTTA GTCCTGAGGT CAAAGCCACT TTAGAATGGG AGACAGACAC
640251 CTATGTTGTT AACATTAATA CTGTACCGTA AGTGTTCTAA AATTGATTGA
640301 GATATAAAGG GAGGAGAAAG TAAACTGTCA AGACTTCCTA AAACAGAGAA
640351 ATTCATAGGA GAGTTTACAA TGGAGATGAT ATTTAAGCTG CTTTTTTTTT
640401 AAAGTATATG ATTTTTGTCA AGTAGAGATA ACAAGAAGGC AGTCTTCCAA
640451 AGAAGAGAGG AAGGTGCAAG TAAAGTAATA TTCAGGAAAT TATGAGTCAC
640501 TGAGAGAAAT TGTAAAGGAG CCATAAACTC TTTGCCAAGG CTAAAGTCAA
640551 GAAGGGTATT TCCTAGGTTT TCTTCTAGGA TTTTTATAGT TTGAGTTCTT
640601 ACATTTAAAT CTTTAATCCA CCTTAGGTTA ATTTTTGTGT ATGGTGAAAA
640651 GTAGGAGTCC AGTTTCATTC TTCTACATAT GGCTAGCCAG TTATCCCAGC
640701 ACCATTTGTT GACTAGGAAG TCCTTTCACT ATTGCTTGTT TTTGTCAATT
640751 TTGTTGGAGA TCAGATGGTT AGGGTGTGTG GCTGTTTCTG GATTCTCTAT
640801 TCTTTTCCAT TGGTCTATGT GCCTGTTTTT GTACCAGTAC CCTGCTGTTT
640851 TGGTTACTGT TGCTTTATAG TATAGTTTGA AGTTGGGTAA TGATATACCT
640901 CCAGCTTTGT TCTCTTTGCT TACAATTGCC TTGGCTATCT GGGTTCTTTA
640951 TGGTTCCATA TGAATTTTAG AATAGTTTAA TTCTGTGAAA AATGAGGTTG
641001 GTAATTTGAT GGGAATAACA TTGAATCTGT ACCTTGCTTT GGGCAGTATG
641051 GCCATTTAAA TGATATCAGT CCTTCCAATT TGTGAGCTTG GAATGTTTTT
641101 CCATTTATTC ATTTCATTTC TGATTTATTT CAGCAGTGTT TTGTAGTTCT
641151 CTTTGTAAAC ATCTTTCACT TCCTTGATTA GTTGAAAAAC AGGAGATATG
641201 GGAATAGGGT GAAGTAAAAG ATAAAACTAG AAATTAAGGT AAAGAAGAGA
641251 TTGTAAATGA ACTTAATTAC CAAGCAATTT AGACGTTAAT TCTGCAATAA
641301 ACAATGCAGT CTCAAAATAG CGGAATGAGG CATTAGCGCT TTATACTAAT
641351 TGACTGTTTA ATTATTTCTA GTGCCCTTCC TACTATACAC CCCATGAGAG
641401 CAGAGATCTT GTATTGATTG ACGATATGTC TCCAGAACTC AGAAGAGTAC
641451 TTGCTACCTA GTAGGCATTT TAAGAAAATT TTTTGTATCA CTGAATGTTC
641501 AAAAATAATG ATTTTTCAAG AGTTAGCTTA CAATGGGAAA CCAGATAGGA
641551 GCAAAGAAAC CAGTAAAATA TTACTGAGCA AGAGAAAGCA AAGGCAGAAT
641601 ATGGGCAGTG GCAACAGATT TTATGTAGAA TCAATAGAAC TTCATAACTT
641651 ATGAACTAGA AAGGGTTTAA TAAAGTGAGG AGTCCAATGT CACAAAAGGG
641701 TTTCAAACCT GGATAACTAG ATGGATGGTG ATGTTTTAAC AACACAGGAT
641751 TATAACAGGA AAAGAAAGTT CAAAGGAAAT GTTAAAAGTT TGGATTTGAA
641801 CTGAATGAGG ATGAGATGTG TTTTGAACGT GATCTGATAA TCATCAGGCA
641851 ACACCATAAG AAGAAAACAG TTCTTTAATT TGAGTACTTA TGTGAATAAA
641901 AACAATGATT TAATATAGTA TAACTGTGTT CAAATGGCAT CATCCATATC
641951 TTCTGAGTGC CTTAGAGGCA TAAGAATATT TCATTTATTA TCAAACCAAT
642001 TTGAGATTAT AATTGTAATT CACTATCTCT ACAACAGAAA CATGGAAGGT
642051 AGAAATAGAT TAAATAACTG GTCCAAAGAG TCCTGAGTTG CAACTGGGGG
642101 AAAAAAATAC AGGCACTCTA ACTGTATTTT TTACAGTGAT AATCTAAGTT
642151 ATCACCACAC ATTTTATTGC CTGGTAGACA AAATATAAAC TTGATAGTAT
642201 GTTAAATAAC TGAATGACTT AAATCTGTAA TAGAGTTTTG AGGTTGTTGA
642251 GATTTGTTTT GATTCTTCAT TTTACTGACT GCACATTAGA AATTGCCAAA
642301 CTAATAGAGA ATACTACATC CAGTACAAAC TCATTTCATT ACATGAAAAT
642351 GTTAAGTCTC TGTTATCCTC TTTTTTTCAC AAATATTGTC TGAGGCAAAA
642401 AAAAAAAAAA AACACAAAAA GATTTCACTG GCAAAATACT TTAACCAGGG
642451 TATCTATGGA ACATTTAAAG AATTATTTTG TTTTCTTTAA CAACAGCATG
642501 AGAAAAGTGT AGTCTTATGA TTATATAGTT TATCCACATC ACCTTTATCA
642551 AAATCATCAT AAGTATTAGG GAACATTTGA AAAATATATA TTGGTCAATA

FIGURE 3GGGGGGGG

642601 TTCCCTTAAA GTCTTAATGT AAGAAAATAA TTTTTCTTTT CTATAACAGA
642651 AAAGGATGAT AAGGGGTTTT TGCAATCCAT CGTCTCCAGA ATATCAGTAA
642701 CTGATTTCTT AGAGGATCTT CATTCAAATG CAGTTTAAAA TATTCATAAG
642751 CATTTCTGGG ATATTTATGA AGGAAAACCT AAGAAATTCA CCTTGTGTGA
642801 CTTGTAGAAG TATCTTTGAA AGTCTCTTAA ATCAAATACA TGAGACTTGA
642851 AAATGATCTG GGGATTTCAA GAATTGACTA ATTCAAGAAG CCTGGTTTGT
642901 CCACTGACTT TAGTATGATG CAAATACTAA GATGATTCTG TGATATGAGG
642951 CAGAAGGGGT GACTGGCTAA AATTGTACAA AAAGAAATAA GGTGTAACAT
643001 TTTGAAAATT TAGAAAGAGA TAATAAATTA CTTCCCAATA TATCTTCCAA
643051 GAGCAATAAT GCAATATGTA ATTTTTACGT ACTGGAAAAG ACCAAAAAAC
643101 ACTGTTGCCA ATAGACTTCT CTCACCTAAA ACAGATTTAA AGATTAACAT
643151 CCTAATTTTC ATAGTTTCCC CTGTACTTAT CTATTTTCTT GATTATAAAA
643201 TGTAATCATG GATTGTAAAG TTGCTTATAA TCTTCACAGT ATGACTAGTT
643251 TCTTCTCTGT TGAAAACCAA GACAAATTAC AGGCTAGATG GAGCAATAGT
643301 AAAAAAAAAA AAAATTCCTT AGTTCAATTA ACAGCTGTTC TCAGTTGATG
643351 CTACTGCACA AAATACAAAA GATTAAGAGT TCAAATGTGA AACTTCTAAT
643401 TCACAGGAAA CCAGGGAAGC CTTCATTTGA TTTTTTATTA TTCTTAATGA
643451 GAAGATAGAA CTTGTTACTG ATGAATTTTA AGATTACCTA AAGTATCTCC
643501 CAAAGAGTTA TAGGTAGAAC TAATTTCGAA GTACTGTATA TTCACATAGA
643551 TCAGATCTTG TTGAAATACT CCAGAGTGAG TTTCTTAGGA ACTATGAAAT
643601 CAAGAAAAGT TAACTTGTTT TTATGAAGCA CCTACTATGA TTAGCTCTAT
643651 GGCAAGTGAC CTTGAGAAAC CCAGTGAATG AGGATACAAA GCATTATGGG
643701 AAAATAAGAA AGAAAAACAA CTTAATATAA AAACAGGCAC AACATTTCAT
643751 AGTGTACACA ACAGATGTGA TGGAAATGCA ACTATGAGAA ATATCACTGT
643801 GAGAGACTTT TAGGGAAGAG GTGTGTTGTA TAAATTCTAA GGGAGTGGGG
643851 AGAGACGGTA AGATTAGAGA GAGAAGCAAA TTGGGAGATT ATCCTGGCAG
643901 GTGACTACAA AAGTAAAGGA AGAAGGAGAC AGGATTAAAT AAATACAAGT
643951 ACTAATAACA ACTGGTAAAG CCGTGGATAC AAAGGCTAGT TAGGAAAGAT
644001 GAGGTGCATC ACTGGAAAGA ATTGACTAAC AGGGTGAGAC TTGGAGCTTT
644051 TATCTATAAA TGCTGTCTGA AAGGCACCTA TAGCATAAAG GTTAAGATCT
644101 CAAACTCTGA GACAGACTAC TTGATACTGC CACTTACCAG CTATTTGACT
644151 TTAGACAAGC AGTTTAATTT TCTATCCCTC AATTTCCACA TCTGCATAAG
644201 AAAAATAATT ATGGCATGTA GCAATACAAG TGGAATGCTT GCAAGCTCTT
644251 TTTATTCTAG TAAGACTGGT ATTCTTAAGG GAAGGATAAA TGTTTGTTAA
644301 AGAAAATAAA AACTAAAAGT ATTCCTCTGA CAGCAACAGT CAAGACAGAT
644351 TAAAAAGCTG TGACTCTGCA GGCAGGGGAA GAAGACATCA GGCAGTCATT
644401 GTAATAACCC AACTTTTCCC ATTAACATTC AGAATCCATC ATCATTCAAA
644451 ATGGAATATT GGTCTCAGAA TTTTTATATT TAAGTACAAA AACGACCTTT
644501 TATTTTCCCC ACCTTGCTAC CTCAGTGTTT CTATCAGTCT CCTACCTCCA
644551 ACCTCTCTGA AACTATAGCC AAATAAAAGA TTTCATGATT AACTTTAAGG
644601 TTTAAAACCT GAATTTTCTA GATCCCTGCC CACAAGAGTG CTGACAGTTC
644651 AGTTGACCTC AATAATTGAC GATAAAGTTC TTTATTCATA TTTGGGTAAA
644701 ATTAATGACT TTGAGGAACA TTATAGAATA TAAGTTAATA TTCACTACAA
644751 ATGGAAAACT TCCTTGGGTT CTAATTTTAT GCATGATAAA TTGGGAGCTT
644801 TATTAATACA TTTAACCTTT AGCACATCTT TATTTAAAAT ATAGATTCAA
644851 ATGTAAAGTC TAGCATTTAC ATACATTGTA CTAATTCGTA ATAGTCACCA
644901 TCACCCTTTC TAACCCACAA GGCTTTGAGT TCATAAAAGG AACATGAATT
644951 ACAATATGTA ATATTTCCAT CATTGGTACA CATCAGTTCT TTCTAGATCT
645001 CCTTTGTGTT TGTAAGGAAA AACTGTGCAT AGTGCAGATT GAAAAGTTAA
645051 AAATTCCAAC AAGAAGTGAG AAATACAGAA GTAAAAACTA AATATGTCAT
645101 ACATGCTTAT TTCAGGTGAA TACCATTTCC CCTGCATCTG AAATGAGTTT
645151 ATCTTTTAAA CTTGGGCAAT TGGGCAGAAC AAATGCATTC ACTTCTTTGA
645201 AATAAAGCAG TTATTTATGT CGAATATTCT ACCTAATAGA GGTGTATTGG
645251 GAACTATAAC AGTGTACCAA TTGATATGAT AAAAAAGGAA AGAAAATATG
645301 TTCAGTTTCT GATCTTATCT TCTATACCAG ACTACAAAAT CAGAGTTACT
645351 TATTTTTCAT GTACTGCCAT CATTGCTCTG TTGATTAAAT CTATGTCCAA
645401 TGAAGACATA ATCAGGAACT ATTACAAATC CTACAAGCTC TGTAGCATTC
645451 ATCAATCTAA AATTTTTCTG CTTAAAGGCC CTTAAAATCA GACTATGACC
645501 GATGGTTTAT AATTTCTTTG AGAGAATTTA TGAGTTTCTC CTTTCTGCTT
645551 TGCCTTAGGA ATATTTCAGA AATGCCCACT GTAATATAAG TCAGGCAAAA
645601 TTGCTGCACT GCCTTAGAAG TTGTACCACA ACTGCAAAAG CAGCTATAAT
645651 AACTGCTTAA ATCCTGACTT CAGCTTGTTG ATTGTTTTCT AAGGAAAAAC
645701 TAGAGGACAA AAAGAACATA ATCTAAACAA GTGATTGCAG GGCTTTAGGA
645751 AAAGAAGTAC CTAATTCCTT TGTAATTTAT ATTGTAATTC ATGTCCCTTT
645801 TATGAACTCA AAAGGAAATA ATGCTATAAA GAAATATAGA GGTGCCTATG
645851 TATAATATGA ATACGTTTAT AGAAGCAGGC TGGAAAATGA AATTCCTATT
645901 AATAAAATAC AAATAATTTA GTTGCCACAG CTGGGTATCT CTTAACTGCA
645951 GCACATATTT CTGTAATTGC TCTAATCCAT GTGTATTCTC TTGCTCTTTT

FIGURE 3HHHHHHHH

646001 GCAGGCAGAC CAGTAATGAT TGTGGTGGAA TATATGGAGA ATGGATCCCT
646051 AGACTCCTTT TTGCGGGTGA GGTGTTCTTT TCTGATGGCA TTTAAATAAG
646101 CTATTCTCAG TTCTATATTT AAATCATTTA TCATAAATTA ATTTTTGCAT
646151 AATGTTATTC ATGGATTTTC TGTGAAGAAT AGCAGTGTTT TCTCTAGGGT
646201 GCATTTCCCT GATACTGTGA TACATTAGAG TGTTACTAAG GGGGGAGGAT
646251 GTACACTCAA TAACGTAATT GATTTCTCCT CTAAATTCAC TTGCTATATG
646301 TGTGTGTATA TATATGTGTG TGTGTGTATA CCAAATAATG TTATCATGAA
646351 GAAAGATTAA ATGAAACTCA ATTGCCTCAC AGTCATTAAT TTTGCTTTAT
646401 CACATTTAAC TATGTAGTAT GATATTGTAT GCATTATCTA TAATGCTGAA
646451 CTCCTTAACT GATCTGTATT TACCAACAAT GACTCAAGTT CATTTCAGAA
646501 AATGTTCTAT CAACTTTGTC CTTCTTCAGT TCATTTGGCT GACTATTCAG
646551 AAAACAAAGG GAGGAGGAAT AAAACTCCTT TAGCAGAGAT TTCTTTTACA
646601 AAAACATTAT TTTTAAAGTG ATTTATCTTT AAAAGTATAG TATATACGAA
646651 AAGTAATTTA TTATAGATAG TGATACAAAC ATAAACTGAG AAGGCACCAG
646701 GAAGTTAGAT TTCAAGGTAT ATTTATAATA CATTTAAGAT TTGAAAAAGC
646751 ATCATGTGCT ATGAAAATAT TCATTGATAG TGAAAAAAGT GAAATATAAA
646801 AAATAAATGC TATAGTAAAT ATTTTTCATC CCCAGCAAAG GTCATATATT
646851 TGCATGTCAC TGTATTTTTA ATATCTATCT ATCTGTCTAT CTGTCTATCT
646901 ATCTATATAT ATATAACTAT TTTTCTCACT TACAAAATGG CTGGACTTTG
646951 CCACTTGGGA TGTTACATTA TTTTTCTTCT TTATTTTCAT GTGAAAATAA
647001 AGCATTCACT TCACTTCGTT TTTTGCCCCA TGTTATGTGA ATAAGTTCTG
647051 TTTGCATCTC ATCTTTCTCT CTTGATCTCA TTTTCATTTA TTTTTCTTGG
647101 TTCTGGGCCC TCTTCTTCCA ACTGCTCTGA ATGCTAGCAG TGATGATATA
647151 TTTATACTCT GACTGGGCTT GATGTCCAGA TTCAATCCTA GAAGCTGAAT
647201 TCAGCAAAAT CATCAAGTTA TTATAGAGCA ATGCTGCTCG TGCAGTGTAT
647251 ACTCTCAACC AAGTGTGCTC TGTAAGGTAA AATGAAATTC AGAGGTGTTT
647301 GGGGACATGA ACTGTTTGTT CTTTTCTGTA GCCATTCTAA AAATGTGTTA
647351 TTTTATAGCT TGTGTTCATT TAACCTGTTC TAAATTATTT TAGAATAATT
647401 TACAGGACCA CCTATGGTAC TTGAAATGCT GTGTACTTAG TACTTGAAAT
647451 GCTGTATACT TAATGTCCTT CCATTATGTT TCTTCAAAAA CTCATTCTTA
647501 TCAGATACAT ATCAAAATGA CTCATCATCT AATGATGCTT GGGTTAGGTT
647551 GGTTTTCTTT TTATTTTCTT CTTTTTATTT TTGTATCAGC TGTATCCTAA
647601 AGCAGAATAT AATGGCAAAC AGTGTAGCAG ATATTCAATC TAAATTGCTG
647651 CTAAAAATGG ATCAAATGAC TACCACAAGC AAATAAGGTG GGAAATATTA
647701 GCTTCTCCCC TAATTTATAT ATTTTATTCT GTGGAATAAT GAATCCATTA
647751 AATGTTTTAA AGAAACAATA ATATGTTACA AATAAAAGAT TTACTTCTAA
647801 ACATCTTACT ACATGTTTAG AAGTAGTGTA TTTTATGCTT TAAATTTTAA
647851 AAACTAATAT TTTTCAGCTC TTATTATGTA CTGTGTATGT AAGACATTAT
647901 CAGAGATTCT GAATACCTAT CTCAGCTAAT TTTGGCTCTA CTCATGGACT
647951 ATGTGACCTT GGGCATGGTA TCAAATTCTC TGTACCTCTG TTTACTCATC
648001 TATAAAATTC TCTGTACCTC TGTTTACTCA TCCACCTCAT ACAATTATTA
648051 TAAAGATTGA TTGTTGTAAA GCTTGCAGAA TAGTGCTTGA CATATTGCAG
648101 GTGGCAGAGC AAGGATTCAA ACTCAAGTCT CTATGACTCA AAAAGCCATG
648151 CTCTCATGCG TTATGAATTC ATTTTATTAA ATTGCTTACT ACTTTTCCTT
648201 ATAAGTCCAC TACCATCTCC TCATGGTGTG TGTCCCCTTT GCACGTAGAG
648251 TTTCTAAAAG TCACATTATT ATAATGCAAA AAAAAAATCA AATGAATGGA
648301 AAAATAGGGT CAATACTTCC ATCTTACTCT TCTTTAATGT TCTTACCCTT
648351 CTTTGTAATC ATCTCTCTTC TTAGAAGCTC AAAGTGCTTT ATAAACTTTG
648401 TGTTAATAGC AGATACTCAA CTCCCCATGA CAAGCGGAAA TAAAATATAT
648451 AAATATATAT AGCCCATACA TTCTCAAAAG CAAAGTCATT TTTCAAACTA
648501 CAGCTTTAGA ACATAATCAC AGCTTATGTG AGCACAGGAA GGAGGAAGTG
648551 GCTAAGTGCA CTGTGTAGTA GGGGAGCCAT CCGTGGCTCA TAATAGCCTT
648601 CTGTGCTTAC TGGAAGCAGA AATGATTTCC CTTTGGTCTC CCACACTATT
648651 TGAAAACTGC TTCAATTTGT TATTTTATTA TGAAGGAGTG GTAGCACTAC
648701 TAAGTACAAG ATTACATCTA GTGTCAGTGC TGGTTGCTGG CTGGCTGTCA
648751 TATTGCACTG GATTCATCAA TCTCATACCA TTTGGGATCC TTGGGGACAT
648801 TCTTCCAGAT ATATATCGGC AGAGGGGCAG TGTAGTCAAG TGTGTGTGTG
648851 GGCTTGTGTG TGAAAATATA CATGTGTGTA GAGAAGGGAT GTGTGTGTAA
648901 CCGTGTGTAT TTTTAATTTT AAAGTTGAAT ACATTCTGAC TTAGCAAGCA
648951 AATCATCAGC AGCCTGGCTG CCCAGAAGGC ACAACTTCAC CAATGTGCAG
649001 AATTTTTAAC TTTTCTAAGC CCATTTGGGG ATAGTGGTCA AGGTTACACT
649051 TAATTCACAC TAATGTATTT TCTCTAATTT CACTAAAATT CACTAGTGCG
649101 AATTAAATGT AACCTTGACC ATTATCCCCA TACAGGCTTT TTCCAGCTAC
649151 ACATTTGGAT TTCATAAATA CTTTTTGTGG CACTTACCTG CAAACCACCT
649201 ACCTCTAAAT TTTAGAAATT CCCATTTCAG AACATTCCAC TTAGAACTTC
649251 CCATTTTTTA TAACAATATT AACTAGAATC TAAACTAAGT ATAGCTATAG
649301 AATACTTTAA CATTGTTTTT TGTTTTTTGT TTTTATTATA CTTTAAGTTT
649351 TAGGGTACAT GTGCTTATAG AATACTTTAA CTTTGAAATG CCACATGTCA

FIGURE 3IIIIIIII

649401 ACCACAAAAA AATTCCTTTG TTTTATAACA TTTGTTGAAT GTTAATTTAT
649451 CATATTGCAA AATTCAGTTA TACCAAAATA TAATACTAAA TTTACTACTG
649501 GTTTCAGTGC AAGATGGTGT GTTCATGAGA GAAAAGGTAT ACTTACTTTT
649551 TTTTTTTTTT TTTTTGAGAC AGAGTCTTGC TCTGTCACCA GGCTGGAGTG
649601 TAGTGGCACG ATCTTGGCTC ACTGCAACCT CCGCCTCCCG GGTTCAAGTG
649651 ATTCTCCTGC CTCAGCCTCC CAAGTAACTG GAACTACAGG TGTGCACCAC
649701 CACACCCAGC TAATTTTTTT TTTTTTTTTT TTTTTTTTTG TATTTTAGAA
649751 GAGACGGGGT TTCACCACAT TGGCCAGGAT GATTTCAATT TCCTTATCTC
649801 ATGATCCGCC TGCCTTGGCC TTCCAAAGTG CTGGGATTAC AGGCGTGAGC
649851 CACTGTCCCT GGCCTATACT TACATTTTTT ACAGTGCAAA TCACTTAGGC
649901 AAATAAGAAA GGGGGTCATC TATAAACCAA AAATCTAGGA GAAATTAATA
649951 AAGAAAGCAA GAAGGATTTA ATTAAGTAAG GAAATCAGCT CAAAATATGC
650001 TCAGGGAAAG ATGGCTGGGA GCAAGAAAAG TGAGTGGAAG GTGGTGCTAT
650051 CAATTGAAAT AAAGATACAG AGGAGGAACA GGATGGACTG GTAGTTGGAA
650101 AGAAATGGTA AGTTTAATTT TGGTCATGTT GCATTTGAGA TGTCTGTGAA
650151 ACATCCACTG AAAATGTTCA GTGGGTGGGG ACCAAGATGG CTGACTAGAA
650201 GCAGCTATGG TGTGTGGCTC TTACAGAGAG GAATGAAAGA GGTGAATAAT
650251 ACAGAACCTT CAACTGAAAC ATCCAGTACT TGCACTGGGA CTGATCAGGG
650301 AAACAGTTTG ACCTACAGAG AATGGAGAAA AGAAGGTCAA TGACCCACCC
650351 AGGAGCAACA CAGAGCAACG GGAACCTCCC CTACCCTGGG AAGCAGTTAG
650401 TGAATGTGTG ACCCCCGGAA ACCACACTTC TCCCATGGAT TTTTGCAACT
650451 CTTGGGTCAG GAGATGCCCT TGCGAACCCA CTCCACCAGG GTTTTCAGTC
650501 TGACACACAG AACTGTGTGA AGTCCTGGCA GAGAAGCTTT GCAGATTCAC
650551 AGAGTCCTGG GAGCTTTATA TACGTGGGCT CTGGGGTCCC CGGCAAATGT
650601 GACAGTGACT CAGGCAAGGT GAAAAGTTGG ACCTCCATAC ATAGCCCTGA
650651 AAAGGGAGCT GAATCCAGGG GGCAGAGCAG CATCGGTCTG CAGGCCCCAC
650701 CTCCACAGTA GCCTACGGGA TAAGACCTAC TGGCTTGAAA TTCCAGCCAG
650751 CCCCTGGTGA CATTGTTGTA CCTACCTGGG ACAGGATAGA GTTCCTGGGG
650801 GGAGGGGCAG GCCTCCATCT TTATTGTTTG GACAACTTAG CCATTTCAGT
650851 CTCTGGGCTT TGGAGAGTCC AAATTGACCA GGGATAGAAG GGATCCCCCA
650901 ACACAGCACA TCTGCTCTAC CAAAACATGT CCAGATTGCC TCTTTAACCA
650951 ATGTATTCCT CCTCACTGGT GGGGCATCCC AACTGGGCCC TCCAGCCACC
651001 CCCTCCTGTG TTCTCCAGCC CAACAGAGAT TTGAATTCTC CCTGGTATGG
651051 AGAGCCCAGA AAGGGGTGGG CTGCCATCTT TGCTGTCCTG CAACTTAGTG
651101 GTTACAGCTT CCGGGCTTTG GAGAGCCCAA GCTGACCAGG AGCAGAAGCA
651151 GTACCCCAGC AGGACACAGC TACTCTACAA AAAAGTGACT AGACTGCTTC
651201 TTGAAGAGTG TATCTAATCC TAATCCTCCT GACTGGGTGA GATCTCCCAA
651251 GCAGGGTCTC CAGCCGCCTT CTACAAGTGT GTTGGAACTG GCAACAGGAT
651301 CCATACCTCC TGGGACAGAG CTCACAGAGG AAGGGCCATC TTTTGCGGTT
651351 TCAGAGCCTT CACTGGTGAT ACCTTTCAGG TACTGGAAAA TCCAAGGCAA
651401 CCAGGCACTG GAGCAGACCC CCAGAAAATT ATAGCAGCCC TATAGAAAAG
651451 TGGCCGGACC ATTAAAAGGA AAAAAATAAA TAAATCCAAA GGTCAGCAAC
651501 CTCAAAGATT GAAAATGGAG AAGCCCACAA TGATGAGAAA GAATCAGTGC
651551 AAGAACACTG AAAACTCAAA AAGCCAGAGT GTCCTCTTTC CTCCAAATGA
651601 CCACATTACC TCTCCAGCAA GGGTTCAGAA CTGGACTGAG GCTGAGATGG
651651 CTGAGACGAC AGAAGTAGGC TTCCAAATGT GTCTAAGAAA ATCTTCACTG
651701 AGCTAAAGGG ACATGTTCTA ACTCAACACA AGGAAGCTAA AAATCATGAT
651751 AAAACATTGC AGGAGCTGAC AGTCAAAATA GCCAGTATAG AGAACATAAC
651801 TGAACTGATT GACAGAGCTA AAAAACACAA TAAAAGAATT TCATAATGTA
651851 ATCACAAGTA TTAATAGCAG AATAGACCAA ATAGAGGGAA GAATCTCAGA
651901 ACTTAAAGTT TGGGTTTCTG AAATAACACT GGTAGACAAG AATAGAGAAA
651951 AAAAATGAAA ATGAATAAAC AAAACCTCCA AGAAATATAG GATTATGTAA
652001 AAAGATCAAA TCTACAACTG ATTGGTGTAC CTGAAAGAGA TGGGGAGAAT
652051 GGAACCAATG TAGAAAACAT ATTTCAGAAT ATCATCCATG AGAACTTACC
652101 CAACCAAGCT AGACAGGCCA ACATTCAAAT TCAGGAAATG CAGAGAACCC
652151 CAGTAAAATA CTCAATGAGA AGATTATCCT CAGGACACAT AATCATCAGA
652201 TTCTCCAAGG TCAAAATACA GGAAAAAATG TTAATGGCAG TCAGAGAGAA
652251 GGGCCAGATC ACCTACAAAG GGGAGCCCAT CAGACTAACA GAGAACCTTT
652301 TAGCAGAAAC CTTATAAGCC ACAAGACATT GGGGGCATTC AACATTGTTA
652351 AAGGAAAGAG ATTCCAACCC AGAATTTCAT ATCCATTCAA ACTAAGCTTC
652401 ATAAGAAAAG GGAAATAAGG TCCTTTTCAG ACAAGTAAAT GCTGAGGGAA
652451 TTCATCACCA CCAGACCTGT CTTATAAGAG CTCCTGAAGG AAGCCTAAAT
652501 GCAGAAAGGA AAAACTATTA CCAGCCACAA CAAAAAACAC AATGAAGTAC
652551 ACAGAACAGT GACACTATAA ATTAACCACA TAAACAAGTC TGCAAAATAA
652601 TTAGCTAGCA TCACGATGTC AGGATCAAAT CCACACATAA CAATACTAAC
652651 CTGAAATGTA AATGGGCTAA GTGCCTCAAT TAAAAGATAA AAAAATGGCA
652701 AGCTGGATAA AGAACTAAGA CCTATCAATA TGCTGTCTTC AAGAGACCCA
652751 TCTCACTCAC ATGCAGTAAC ACAGGTAGGC TCAAAATAAA GTGATGCAGG

FIGURE 3JJJJJJJJ

652801 AAAATTTACC AAGCAAATGG ACAACAGAAA AAACCAGGGT TGCCATCCCA
652851 GTTTTTGACA AAACAGACTT TAAACCAACA AAGATCAAAA AAGACAAAGA
652901 AAGGTATTAC ATAATGGTAA AGGGTTCAAT TCAACAAGAT GAGCTGGCTA
652951 TCCTAAATAT ATATGCACCA ACACAGGAGC GCTCAGATTC ATAAAGCAAG
653001 TTATCAGAGA CCTTGAAAGA GACTTAGACT CCCACACAAT AATAGTGGAA
653051 GACTTTAAAA CCCCACTGTG AATATTAGAC AGATCATCAA GATAGAAAAT
653101 TCACAAAGAT ATTCAGGACC TGAACTCAGC TCTGGATTGA ATGGACTTGA
653151 TAGATATCTA AAGACCTCTC CACTCCAATG CAACAGCATA TACATTTTTC
653201 TCGTCACCAC ATGGCACTTA CTCTAAAATT GATCACATAA TTGGAAGTAA
653251 ATCACTCCTC AGCAAATGTG AAAGAACTGA TATCATAACA TTCTCTCAGA
653301 CCACAGCACA ATCAAATTGG AACTCAAGAC TAAGAAATAC ACTCAAAACC
653351 ACACAATTAC ATGGAAATTG TATAACCTGC TCCTGAATGA CTTTTGGGTA
653401 AATAATGAAC TTAAGGCAGA AATCAAGAAG TTCCTTGAAA CTAATGAGAA
653451 TAAATATACA ATGTGCCAGA ATCTCTGGGA TACAGCCAAG GCAATGTTAA
653501 GACGGAAATA TTTAGCACTA AATACCCACC TCAAAAATCT GGAAGGAACT
653551 CAAGTCATCA ACCTAACATC AAAACTAAAA GAATGACAGA ACCAGGAGCA
653601 AACAAATCCC AAAGCTAGCA GAGGATGAGA AATAACTAAG ATCAGAGCTG
653651 GGCTACAGAG AAATGAAAAA CCATTGAAAA GCTCAACAAA TCCAGGTGCT
653701 AGTTTATTTA AAAATTGATA AAATATCTAG ACTGCTAGCT AGACTAATAA
653751 AGAAGAAAAG AGAGAAGATT CAAATAACAC AATCAGAAAT GATAAGGGAG
653801 ATATTACCCC ACAGAAATAC AAGCAACGAT CAGAGAATAC TATAAACACC
653851 TCTATTCACA TAAATTAGAA AATCTAGAAG AAATTGATAA GTTCCTGGAC
653901 ACATGCACCC TCCCAAGACT GAACCAGGAA GAAATTGAAT CCCTTAACAC
653951 ATCAATAACA GGTTCTGAAA TTGAGGAAAT AATAAATAGC TTTCCAACCC
654001 AAAAAAGCCC AGGACCAGAT GGATTCACAG CTGAATTCTA CCAGATGTAC
654051 TAAGAAAAGC TGGTACCATT CCTACTGAAA CAATACTAAA AAAATTGAAA
654101 AGGAAGGACT CCACCATAAC TCATTCTATG AGGCCAGCAT CTTCCTGATA
654151 CCAAAACCTG GCAGCAATAC AACAAAAAAG AAAACTTCAG GCCAATATCC
654201 TTGCTAAACA TCAATGCAAA AATCCTCAAC AAAATACTGG CAAACTGAAT
654251 CCAGCAGCAC ATCAAAGAGC TTATCCACCA TGATCAAGTA GTTGTGATCA
654301 TCCCCAGGGT GCAAGATTGG TTCAACATAT GTAAATCAAT AAATGTGATT
654351 CATAACATAA ACAGAACTAA AAACAAAAAC CACATGATTG TCTCAATAGA
654401 TGCAGAAAAG GCTTTTGATG AAATTCAACT CCTTCATGTT AAAAACTCTC
654451 AATAAACTAG GTATTGAAGG AATATGCCTC AAAATAACAA GAGCCATTTA
654501 TGACAAACTG ACAGCCAACA TCATACTGAA TGGGCAAAAG CTGGAAACAT
654551 TGCCCTTGAA AAAGGGCACA AGACAAGGAT GCCCTATCTC ACCACTCCTA
654601 TTCAACATAG TATGGAAATT CTATACAGAG CAATCAGACA ATAGAAAAAG
654651 GGGGGGGGGG GGCATCCAAA TAGGAAGAGA GGAAGTCAAA CTTATCCCTG
654701 TTTGTAGATT ACATGATCCT ATATCTACAA AAGCCCATTG TCTCAGCCCA
654751 AAATCTTCTT AAGCTGATAA GCAACTTCAG CAAACTCTCA GGATACAAAA
654801 TCAATGTGGA ATCATTACGA GCATTCCTAT ACACCAACAA CAGTCAGGCC
654851 AATAGCCAAA TCACAAAGGA ACCAAATTCA CAATTGCCAC AAAAAGAATA
654901 AAACACCTAG GAATACATCT AACAAGGGAA GTGAAAGATC TCTACAAGGA
654951 AAACTATAAA CCACTACTCA AAGAAATCAG AGCTGACACA AACAAATGGA
655001 AAAACTTTCC ATGACTATGG ATAGGAAGAA TCAATATTGT TAAAGTGGCC
655051 ATACTGCCCA AAGCAATTTA CAGATTCAAA GCTATTTCCA TAAAACTACC
655101 ATTGGTGTTC TTCACAGAAC TAGAAAAAAC TATTTTAACA TTCGTATGGA
655151 ACCAACAAAG AACCCAAGTA GTCAAGGCAG TCCTAAGCTA AAAGAACAAA
655201 GCTGGAGGCA TCATGCTACT CAACTTCAAA CTATACCATA GGACTACAGT
655251 GAGCAAAATA GCATGGTACT GGTACAAGAA CAGACACATA GACCAGTGGA
655301 AGAGAAGAGA GAACACAGAA ATAAGACTAC ACACCTACAG CTATCTAATC
655351 CTTGACAAAC CTGACAAAAA CAAGCAATGA GGAAAAGATT TCTTTATTCA
655401 ATAAAGGGTA CTGGTATAAC TGGCTAGCCA TATGCAGAAA ATTGAAACTG
655451 GACCCTTTTC TTACACCATA TACAGAAATT AACTCAAGAA GGATTAAAGA
655501 GTTAAGTGTA AAACCTAAAA ATATAAAAAC CCTGGAAGAC AACCTAGGTA
655551 ATACCATTCA GGAGATAGGC ACGGCCAAAA ATTTTATGAT GAAGACACCA
655601 AAATAATTGC AACAAAAGTA AAAATGGACA AATAGAATCT AATCAAACTA
655651 AAGAGCTTCC ACATAGCAAA AGAAACTATT ATCAGAGTAA ATGGACAACC
655701 TACAGAATGG GAGAAAACTT CTGCAAACTA TGCATCTGAC AGAGTTCTAA
655751 TATCCAGCAT ATATAAGGAA CTTAAACAAA TTTACAAGAA AAAAGCAAAC
655801 AACCCCATTA AAAACTGGTC AAAGGACATG AACAGACATG TAAAAGGAGA
655851 CATACATGTG GCCAAGAAGT ATATGAAAAA ACTCAGTATC ACTGATCGTT
655901 AGAGAAATGC AAATCAAAAC CACAATGAGT TACCATCTCA CACCAGTCAG
655951 AATGGCTATT ATTAAAAAAT CAAACATTAA TAGATGCAGG CAAGGTGGTG
656001 GAGAAAAAGC AATGGCTATA CACTGTTGGT GGCAGTGTAA ATTAGTTCAA
656051 TCATTGTAAC AGACAGTGTG GCAATTCCTC AGAGACCTAA AGACAGAAAT
656101 AACATTTGAC CCAGCAACCC CATTACTGAG TATATACCCA AAGGAATAGA
656151 AATCGTTCTA TTATAAACAC ACACGCATGC ATATATTCAT TGCAGCACTA

FIGURE 3KKKKKKKK

656201 TACAAAATTG CAAAGATGTG GAATCAACCC AAATGCCCAT CAATGATAGA
656251 CTGGATGAAG AAAATATGGT ACATATACAC CATGGAATAC TATGCAGTCG
656301 TGAAAAATAA TGAGATCACA TCCTTTGCAG GCACAAGGAT GGAACTAGAG
656351 GCTGTTATCC TTAGCAAACT AACACAGGAA CAGAAACCAA GCACTGCATG
656401 TTATCATTTA TAAGTGAGAA CTAAATGATG AGAACACATG GACAACACAT
656451 AGAAGGGAAC AACACACACT GGGGCCTCTC AGAGAGTGGA GGGTGGGAGG
656501 AGGGAGAGGA TCAGGAAAAA TAACTAATGG ATGCTAGACT TAATACCTGA
656551 AGGGTGAAAT AATCTGTACA ACAAGCCCCC ATGACACAAC CATTTAAGAA
656601 ATCTGCACAT CCTGCACATG TACCCCTGAA CTTAAAATAA AAGTTTTGAA
656651 TTTCTTTTTT AAAAAAGGAA ATGTCCAGAC AGCAATTTAA AATACAAATC
656701 TGATGCTCAG TGGAAAAATC TTGGCTAAAG TTGAACATCT GGGTCTTGGT
656751 AGCATAAAGG TAGTTACTAA ATGCAAACCA GGATATTTCC TAAGAAGAAA
656801 GTTGAACCAG GGTGGAACTT TGTGCCATAC CAATCTGAAG GGCCCCATGG
656851 ATGGAATACC CAAAGGTAAC TAGGCAAGAG TGGGCAAAGA GGAACAAGGA
656901 AGGAGAGAAA AACATGAAGT CCCCAGACCC AGGGGAATAT AGCTTTTAAG
656951 TCAGAAGCAT ATAACCGATT GTGACAAATT CAGGAGAGGA ATTCTGAAAG
657001 ACAGAAACAG AGAAACATCT ATAGGATTTA GCAAATAAGA GGGACTCAGT
657051 GTTCTCAACA AGAGCACTTT CAATGGCTTG GTCCCAGGCA GAAGCCAGAT
657101 TGCAGAGAGC AAAAATGAGA ATGAACAACT AACAGGAATT TGTAGGTGGA
657151 GATGATTCCT TTGGGAACAG GTGGATGAGA TGTCAAGGCA AGCAATAAAT
657201 CAAATGCTAG TATGCTAGTA GACCAAAATA TAAGAAAAAT CAAGGATTTC
657251 TTTTCAATTT TTTTATTTTG ATAAAATACA CATAACATAA AATTTACCAT
657301 CTTAACCATT TTTAAGTGCA CAATTCAGTG GTATTAAGTA CATTCATATC
657351 ATTGTGCAAA TATCACCAGT ATCCATCTGC AGAACTCTAT TTATCTGGCA
657401 AAACTGAAAT GCTGTACTCA TTAGGTAATT AAACTTTCCC ACTTCTTTAA
657451 AATCATTAAA CTCCCCACTT CTCCCTTCCC CCAGCCCCTG GCAAACAGCA
657501 TTCCGCTGTC TGTCTCTATG AGTTTGACTA CTCTTAGTAT CTCATGTAAG
657551 TGAAATCATA TAGTATTTGT CTTTTGTGAT TGGCTTATTT CACTTAGCAT
657601 AATGTCCTCA AAGTTCAGTC ATGTTGAAGT GTATGTCAGA ATCTCCTTTC
657651 TTTTTAAGGA TAAATGATAT TCCCTTGTAT GTATATGCCA CATTTTGCTT
657701 ATCCATTCAT CTCCTGGTGG ATATTTGTAT TGCTTTCATG TTTTAGCTAT
657751 TGCGAAGAAT GCTACTGTGA GAATAGATGC ACTTTGACAC CCTACTTTCC
657801 ATTCATTTGA GTATATATCC AGAAGTGGGA TTACTGGATA ATACTTTAAT
657851 TCTATTTTTA ACTTTTAGGG AAACCACCAT ACTGTTTTCT ATAGTGGCTA
657901 TGTCATTTTA CATTCCTACC AACAGAGTAC AAGGGTTTCA ATTTCTCTGT
657951 ATTCTCACTA ACACATGTTA TTTTCTGATG TTTTTGTTTG TTTTATGTTT
658001 GTTGTTATAA TGGCTATCCT GATGGATGTG AAGTGGTGTC TCAACGAAGT
658051 TTTAATTTCT GTAATGATTT GTGGTTTTCA GGATCTTTTC AGTGCTTATT
658101 GGCCATTTGT ATATCTACTT TATAAAAGTA TCTATTCAAG TCCATTTTCC
658151 ATTTTTGAAT CAGGTTGCTT GATTTTTTTT TGTTGAATTT TAGGAGTTCT
658201 CTATATAGGA TGGATACTAT TCCCTTAGGA GATATATGAT TTACAAGCAT
658251 TTTCTCCCAT TCTGTGCGTT GCCTTTCTAC TCTGCAGATA GTGTTTTTTG
658301 AGGCACAAAA GTTTTTAAGT TTCATGTGGC ACAGTTTGTC AGTTTTTTCT
658351 TTTGTTGCCT GTGGCTTTGG TATCATATCT AAGAAATCAT TGCCAAATCT
658401 AATGTTATGA AGGTTTTGCA CTGTGTTTTC TTCTAAGAGT TTTATAACTT
658451 GAGGTCTTAC ATTTAGGTCT TTGATGCATT TTGAGTTAAT TTTTACATAT
658501 GTTTTAGGTA AAGATTGAAC TTCATCATTT TGCATGTTGA TATTCAGCTT
658551 TCCTAGCATC ATTTATTGAA AAGACTGTAC TTTCCAAATT TAATAATCTT
658601 GGCACCCTTT TCAAAAATTA TGTGACCATT GTATTAGTCC CTTCCTGCTT
658651 GTATAACAAT ATAACACAGA TTGGATAATT AATAAATAAT AGAAATTTAT
658701 TTCTCACAGT TCTGGAAGCT GAGAAGTCCA AGCCCAAGGG TAATGGCTTA
658751 CTATCCTTCT AAGATGGCAT TTTCTTGATG CATTCTATAT GACAGAAGGG
658801 ACAAAAGCTG TGTGCTTACA TGGTGGAAGA GCAGAAGAGC AAAAAGGGCA
658851 AAAAGGAGCT AGGACGCTCT TTTCACCCTC TTTTACAATA GCATTAATCC
658901 CATTCATGAG GATTGAGTGT TCATGAGTTA ATCATTTACC AAAAGCCCAA
658951 CTCTTAATAC TATCACATTA AGTATTAGAT TCCAGCATAT GAATTTGGAA
659001 AGGACACATA CATCCAAGCC ATAGCAATCA TACATGAAAA GGTTTATTTC
659051 TGGGCTCTCT AATCTATTCC ATTGGTCAAT ATGTGTGTCT TTATGCAAAT
659101 ACCACAATAT TTTGATTATT GTAGCTTTAT ACTAAGTTTT GAAATCAGGA
659151 AATGTGAATC CTCCAGCTTT GCTCTTCTCT GTTGGTTATC TAAGGTCCCT
659201 TGAAATATAA CGTGAATGTG AATTCTAGGG TGGACTTCTG TGTTTCTGCC
659251 AAAAAAAAAA GTTGTTGTTG GAATTCTGTT AGTTATGTTG AATCGAAGTT
659301 GTGAAAGTGC CATCCTGGCC CTCTTCATTA TCTTAGAGGA AAAACTTTCA
659351 ATTTATAACG GTCGAGTATG ATGTTCACTG TGGGTTATAT AAACATACAT
659401 ATAGCTTTTA TTATGTCAAA GTAATTTTCT TTTATTCCTA GCTTGTTGAG
659451 TGTTTTTATC GTGAAACTGT GATGAGTTTT GTCAAATGTT TTCTTCTTCA
659501 CCAATTTAGA TCATTGTGGA GATCTTCCCC CTTCATTCAG TTAATGTGGT
659551 GTGTTACATT GACTGACTTT CATATTTGAA CCATCCTGAC ATTCAAATTA

FIGURE 3LLLLLLLL

659601 TTAATTTGAA TTAATTCAAT TTGGCCATGA TGTATAATAC TTTTAACATG
659651 CTGCTGAATT CCATCTGCTA GTATTTTCTT GGGGATTTTT TCATAAATGG
659701 TTAAGGGATA TTGGTCTATA GTAATGTGGG GGTTTTTTGT AGTGTCTTTG
659751 TCTGGCTTTA GTATCAAGGT AATGTTCATG GAATGAATCA AAATGTCTCT
659801 CTCCTCTTCA ATTTTTCAGG ATGAAGTTTG AGGAGGATTT GTGTTCATTC
659851 TTTAAATGTT TGGTAGACTT CACCAATAAA GCCATCATCA TCAGGTCCAA
659901 GGATTTTCTT TATCAAGAGA TTTTTTATTA CTAATTTAAT CTTATTACTA
659951 GTTATAGGTC TATTCAGGTT TTTTATTTCT TCATCATCTA GTCTTGATAG
660001 GTTTTGTGTT CCTAGGAATT TTTCCATTTT ATCCAGGTTA TCTAATTGTT
660051 CACATACAAT CATTTATAGT ACTGTCATAA TCCTTTTTAT TTCTGTAGAA
660101 TTGGTAGTAA TATTACACCT TCATTCTGGT TTTAGTAATT TCAGTCTTCT
660151 CTTCATTTTC TTGGTCAATC TAGATAAAAG TTTGTTGATT TTGTTGTTCT
660201 TTTGGAAGAA CCAACTTTTG GTTTTGTGGA TTTTCTTTAT TGTTTTTCTA
660251 TTCTCTATTT TATTTATCTT TCTTCTAATA TTTATTTCCT TATTTTTGTT
660301 ACCCTTGGTT TTAGTTTGTT CTTCTCTTGT TCCTTACGTT GTTAAGGTAG
660351 GTTGTGGTTT GGAGATCTTC CTCTTTCTCA ATACAGACAT TTATAGCCAC
660401 AAATTTCCTC CTTGGCTCTG CTTTGGACGT GTGTCCTACA AATTGTAATA
660451 TGAGGTACTT TCATTTTCAG TAGTCACTAA GTATTTTCTA ATTCTCTTTG
660501 TGATTTCTTC TTTGATCCAT TGGTTGTCTA AGAGTTTATT GTTTATACAC
660551 AAATTTGTGG ATTTTTCCGT TTTTCTTCTG TTATTTACTT CTTACTTTAT
660601 CTGTTGTAGT CAGAGAACAT ACTTTGTATG AAATCTACTA TTTGAAATCT
660651 CTTGATACTT AAATTTATTG TCTAACATAT GGCTTATCAA AGAAAATATT
660701 CCACATGAAA TTTTGTTCTA TTTTTCTTGG GTATAGTGTG TACTTCTGTT
660751 AGATCTAGTT GGTTTATTGT GTCATTCAAG TCCTTTATAT TCTTATCTTC
660801 TCTCTGGTTG TTCTGTCCAT TTTTCAGAGT GGGATTTTGA AATGTTTGTC
660851 TGTCTGTTTC TCCCTTCAAT TCTGTCAATT TTTGTTTCAT ATATTTTGAT
660901 GGTCTGTTGT TACTTATGTT AATGTTTGTA ATTGTTGTAT CTTAAAATCA
660951 AGGATATTTT TAAAATAGAT GACAATTTGG ACTATGTATA CACTGAAAAA
661001 GAAGAAGGGA CCATTTAAAA ACTTGATAAA ACAAAAGATT TAAGGAGATG
661051 AAAAGGTACA AAATCAAGGA ACCTAGTGGA GGATTGACTT TGGAGAGTAG
661101 AAGCCGCCAC ATCTCCCAAG ACTGGAGTGT TGGGAATCTA GATAGCTTTA
661151 TGAGGAACAT GCATAAATTG AAGGAAATGA TGCCTGATTC TATTGCATTT
661201 CTATACAAAG TAGTAGAAGA GTTTTTATGG GAATTTTGAG GACAAACTTT
661251 CCTTTAAGGT GAATGTTTGG AATAATTATT GAAATTAAAA AGAAAAGTAG
661301 CAGATCATGA AAATGCTGGA CCATGAAGAG CAAGTTCTAC TACTGTTTTT
661351 TTAAGGCCCC AGCAGGTGCA ACCAACCAAA AATCTTCATC AAAGTTATTA
661401 ATTGTATGCA ATGTAAGTAT CCAGGAGAGA TGATCTTTTG GCCTGTTGGC
661451 CCAGTTATAT GTGCTAGTTG TATACATTTG TTCCCCAAAC TTGCCAGCCC
661501 TCATCTTGGT CCTGGAGAAA AATAATTAAC TAATAATGCT GAACATTCAG
661551 CTGATGCTGA AGAACATAAA TGTGTTATGG CAGTGATGTG CATGCTTATG
661601 TGATTTTCTA CATGAACACT CAACTCCCCA AATGTAAGAG TGAAGATAAT
661651 AGAAACTATG GTTTGTAGAG CATGTACAAA AGAAAAACAA GGATGCCAAA
661701 AGGGGACTGA GGATGGTAGT GAAGGGATCA TTCAGGTAAC AGACCGTGAG
661751 TCCATGCTAG ATAAAGAAGG AAATAAAGAG CCTAATAGAC TAGAAAGAAT
661801 CGAGAGTATA TGGGCTAGAA GTCTTTATTG CATAGATGAG AAAGTATAGT
661851 TTTGTATGAG GGTAAGAGAG GAAGGGAAAG AAGAATGTGG CCAGAAAGTA
661901 GGGTACTGGC AGTAGTGTGC TAAAGCCAGA TCATACCAGT TTGCAAGAGC
661951 TGGTTGATAA ACTATTAGTA GCTTAAAATT TGCTATGTTG GGAGTAGTTA
662001 CACCACAGGA ATTGGCAAAT GCTACAAATC AGGGCTTTCT GTCTTATTTT
662051 TTCTCTGGAG AGCAGGTTTA CCACCATAAT ACTAGGTTGA TGTTTAAGAT
662101 TTCTAAAGTG AGGCAGTTTT AGAAATGACA ACTTCCAGAT GTCCATTTGG
662151 GAGTCTGTGG CTGAAATAAA GATGAGATTA ATATACTTAA TAAACTAATG
662201 TAACTAACAT TTACATGTGC TTTCTATGGG TCAGTCATTA TTCCAGTCCC
662251 ATGCATTAGC TCACTTATTG TTTACAACAG CACTGTGAAG TAGTTATTAC
662301 CACTATCCTC ATTTTACCAG TGACCAAACT GAGGCAAGGC AAGTTAGGTG
662351 GCTTGCCCAA TGTCAAACAG CTGATAAATC ATTTATTCAT TTGTTATGCA
662401 AATATGTATT GACAGACTAC AGTAGGCCAG GTACTTTTCT GGATCCTGGA
662451 ATACAGAAGT AAGCAAAAGA GAATTAAAAA ATTTAGTGGG TAGAGAAAAA
662501 AGAATTCAGC AAAATATATG GTAAGTCAGA TGTTATTATT GCTGTGGAGA
662551 AAAATAAAGC AGGGAAAAGG CAAGTGGAGT TGAGAGTGGG TTTCAGGATT
662601 ACATTGAGTG GCAGAGAAGG TCTCACTGAA ACATGGCATT TGAGTAAAGT
662651 ATTAGAAGAA GGTAAGGGAG CAAATAAAGT GGATACCTGA GTAGAAAATA
662701 TTCCAGGGAA TAGTAATAGC AAGTGCCAGT TCTCTGAAGT AGGAGCATTT
662751 TATTTCTACA GAATGGCAAA TAAGTATTTA TGCTTGATGA ACATAATGCC
662801 TGTTTTTCCT AAAACAATGC CAAATTATGC ATGTTATCCC TTCACAATTA
662851 TTAGCATGAG CCTTTTACTC TGCAGTTAGA ATAATAAAAT ATATAGTCAC
662901 CCTATCACTA TGGCTAGAGA AGATTATGTA AGAAGAATAG TAAAAGATAA
662951 AATCAGAGCA GATGGAGACA GAAAGGGAAA CATCTCTTGG ACAACAATGA

FIGURE 3MMMMMMMM

663001 TTCTCATATT TGGCTATATA TTATAATAAT TTAAATTTGA AGACCTTTTA
663051 AAAATCTCAA GTTCCAGGCT TTACCCCAGA CCAATGAAAT CAAAATCTCT
663101 TGGGATGGGA CATATGCATC AATATTTGTC AAAAGTTCCC CCAGTTGAGT
663151 CCAATATGCA GCCAAGTTGG AAAACTACTG AAATGAGGCC TAGTAGGCCA
663201 TTATAATGAC TTTGACTCTT CTCTGAGTAA TATGGGAAGC CACTGTAGTC
663251 TTTGGAATAG AGGCATAGCA TGATGACCTA ATTACTATAT TTTATAAGGA
663301 TCACTCTGTT TGCTGTATTA AGAAGAGACT ACAGTGAGGC ACAAATAGAT
663351 GCAGGGAAAT TAGGAGGCTT TTGCCATAAT CCAGGTAAGA GATAATGATG
663401 CTCTAAACTA GGATCGTTGC AGTAGAGTTT ATGGGAAATG GTCAAAGTCT
663451 ATGATGTATG TTAAAAGTAG AGCCAATAGG ATTTGCTGAT GGATTGGATA
663501 AAGTGCATAA AAGAAAGAGA AAATCAAGGA CAACATTTTA CGTACAAAAT
663551 AAGTTCAATG ATAGGCAATA ACTGTTTCCT AAGGTTATTG CACTACAGTA
663601 TTAAATGGCT AATATACATA AAACTCCTAG AACAGTGTCT GCCACATAAT
663651 CAGGTATTCA TAAGGTCATC TATTATTATT ATATTATATT TCAGAAGATA
663701 TCACTAAGAG TCATAAAATT GTCTGTTACT TCCTGATCTG TTTTTTCAGG
663751 TGGCTAAAAA TAGTTTCAAT TTTTACCATT AAAAAATGTA GATATACTTC
663801 AGGAATATGA CTATTGAAAT AACATATCTA AGTGCATATC AGCATTTCAA
663851 CAGCAATGTG AGACATTTGA AGAGTTTCCT TGAGCAAATG TGAAGCAAAT
663901 ATTAATTTAA AAATTAAAGA GATCTTTTAA ATATTTATGT ACTCAAATTA
663951 TAAATCTAGT AAAGATGGCA TTTCACCTTA TACTAGTTAT TTATTAATAA
664001 TGAGAGCTGT ATTTTATTAG CACACTTTTC TTGTAAATTG TGTGCATGTG
664051 GTTATATTTG TGCTGAGGTA GAAAAGTGAA ATTAATCTAA ATAACACTCA
664101 TTTTATATTC AGCAGTGGAA AAGAAGAAAA TTGCATTTAC CCACCAATAA
664151 CTGTTTGTTT GTTTGTTTAT TTATTTATTT GGAGCCTTTA TTGCCCGGGC
664201 TGGAGTGTAG TGGCGTGATT ATAGTTCACC GCAACCTCAA ACTTCTGGGC
664251 TTGAAATTCT CCCAACTCAG CCTCTTGAAT AGCTGGGACC ACAGGCATAC
664301 ACCACCGCGC TAGCTAATTT TTTATTTTTG TAGAGATGGG GTCTTACTCT
664351 GTTGCCCAGG CTTGTCTCAA TCTCCTGGCC TCAAATGATC CTCCTGCTTC
664401 AGCCTCCCAA AATGCTGGGA TTAGAGATGT GAGCCACCAT GCCTGGCCAA
664451 CTGTTTTTAA GCCATAAAAA CTATAGTTGA AACACACCTT AATTACATTT
664501 TTAAGAGAAA AATAGGTTAA ACTTCATGCA GTAGAATGTT ATCTTTTACT
664551 ATACCTGTGT CAGCTTAATG CTAAATACTA TTCTAAAAAT AATGTGACAT
664601 CAGACATGCA CATATATGAG AGCATGGTGT GCTTAGAACC AAGCATATGG
664651 TATGGATGAG TGAACTTTTT TGTAAATTAG GAGTTTGAGC AGCAATATTC
664701 AATAGCATGA GTATACCTCT TTAAACACTG TATTAACTGA TACCATGAAA
664751 TTATAATTTA TAATTCTCAT TAATTCTTCT TTTGCATACA AAACTTGACA
664801 TTGATCTTTT GATTGTATAT AATGTAAAAT TATATATAAA GAAATTCTAT
664851 GTATTTTTCC TGAACTCCTC TATGGTCACT CCTATCCCTT TGTTTGTACC
664901 ATTTATGAGA TATTGGATTT ACAGAACTGA ATATTAAACC CTAAATTTAT
664951 AATTTAACCA TGCTCAATAA CCAGAATCAC CATCTTAGAG AGACTTCACC
665001 AGATACATAT GCAGACACAC ACAGATATGG TCTGCAAAAA CTTCCCTGGA
665051 TTATTCTGAT ATGCTCTAAT GATGCTTCAT CAAGATGATG GCACTTTGTG
665101 ACACCCTACC CCAAATAATA ACTTTAAATT TAATTTTGAC TTTGTATAAA
665151 TATAGTACAC AGTAACTAGT ATATATTACT TTCATATAAA TCTAAGCAGA
665201 AGTTATTTTG AACAAAGCAA ATTCAGTAGT AACCTTTGTA AGCTAAAGCT
665251 ATATTATATT CAGATTCATT TTTAGCTCTT AACATGTAAT TCTGAAATCC
665301 AACCACCATG TTTCACAAAT CCATATCTAC TTATGTTCTT CCTAGGTTTT
665351 TAGGTGTATT AGAAATGACA TTTTTAGTTT TCTTATTATT GAAATTACTG
665401 ATTTCACTCT TGGTGGCCTC TCTCAACTAC AACTAAAAAT ATAACTGTGC
665451 CTAGCTTAAG TTCAAAATGT ATGATGACTA CAAGAGAAAG ATCTTTGAAG
665501 GATTTATTAA GTTAAATTAT AATAAGATTT TCAACTGGGA AGACCACAAG
665551 AACTCAGACA ATTTTCAATA AAAAGGAGAT AGTTACTTAT TTATTTGGTG
665601 GTTATTTTAA AAACAAGAGT GATTTGGTGT TTTGAAATCT ATAAATAATC
665651 CCAAACATTT CTTTTTCAAA TTCAACATCA TTTTAAAAAG TCATAGTGTA
665701 GTCACCTTTT TGATTTAGAA ACATATAAAA ACTGAAATTT AACTTTAAAC
665751 TTAAGTTATA GAAGTAATCC TCCAAGGACT GTTTTCTGCA AAGTCATTTA
665801 TAAATCAATT GTTCAGAACT TAAAATGCAT TTTTCCATAA ATATTTCTTT
665851 TAAAGACATT TCTGAAGTCC CTGGGCAGAC TTATAGAAGC CTCTTTAACA
665901 CAGACTACAG CTAAAAGATG AAACGTCCAA TAAGAAAGAG GCCTGGAAGT
665951 TTCCTTCAAA ATGGGGAAAG TGTGTTTTCC TTCCCTTTAC ATGACTTGCC
666001 CCGGGCAAAA ATTTTAAGGC AATTTTTCTA TGTATCTACC TATTTCGTCA
666051 TGTCTTCCTT CCAAGTCCTC AAATATAAAA CTTTTATTGT GACAAATCAC
666101 ATGTGGTAGC ACTTCTTCAT CCCCTCTTGC CTGAGTTTAG GTCTTTTTCC
666151 ACCTTATAAA ACCACCTGTG ACCTGGACTG TCATCCCATC CTAATCTCAG
666201 TTTCCATTTT CTCATTGGCA CAAATCTTAG CTGGATATAA GGTTAGATTG
666251 ATTTATGCGA GTATGTGACT CACAAATACT ATTCTAATTC CTCCAGATGA
666301 TTTTTCATCT TTTACTGCAT TTGTAAACCC CAAAAATATT TTAATAGAGG
666351 AATTTCAGAG AGCAAAACAA AAGTAAGTGG AAAGAGGCAG ATAATATGGG

FIGURE 3NNNNNNNN

666401 TGAGGATATT TTTGTACCAA AGGACGATCA GTACCCCAAA AGTCAGATCC
666451 TCTGTGTTGT TCTGGCTCTT CAGAGATGCC CATCTTTTGT CTCTTATGAA
666501 CCCTTTGCAT TTCTGACATC CAGTTTTTTG AGAATGACCT CTAGCAACAC
666551 AAAAATGGGA ACGAGAGGCT TGAAGTGTCC AGTGTTTGCA TACCTTGGTC
666601 TTTTGTAAAC CATCTAGTAA GGTAAATGTC CTGTGTAGCC ATTTTATAGC
666651 TCAAGTCAAA GGTTTGGAAT TAATAATTTT ACAAGGCTTC CACTTAGCCT
666701 TCTTTTTTTG TCATTTTGTT TTGAAAGGCT AGTGTCATTT CTTATAATTC
666751 ATAGTTAGTG AACCAAAAAG GCTTTTGATA TACATATGGA CCAAATTTCC
666801 ATTACTTCTT TTTTTAGCTT AAATTGTCAT TATCCAATAG TATTTATTGA
666851 ACCAGATTTG TGAGGAATCT GTGAAATTTG TTTATTGTAG GTACCCATGA
666901 CACCACATTG TGAAGGGTAT CCTCTAAATG TTTGTAGAAT CAGTGACATG
666951 CAATTTTTGT TAATTCTCCT CAAGAATAGC AGCTTATCAT CTACCAGTTA
667001 TAGTGTCATC TACCATCATA TTTAACCTTT TAAGGACACT GAATCGCCAG
667051 AGTTATCTGC TTTAATAATG CACATTTTTC GGCAAGAAAG TTTGAGGGCA
667101 GTGATTTATA TTATGGTCCA TAGATCTTTG ACAGTTTCTG AGCTATTCGG
667151 TTGGTGGGCT TGACATCAGT GATTCTCCAT TGAAGATCTA GAAAGAAATA
667201 TAGCAGATAT CTATATAAGA TATTTAGTTC CCTTTTCCTC ACTCTTCAGC
667251 AAAAATATAA AAATTTTGTA GTAGTCATAA TCAGAGTCTT GTCCTCAAAA
667301 GTGGAGACGG CTGCAAGTGT AGTCAACACT TCAGTACTTC TTGGTCATTC
667351 GTGATCTTTG CAGAGAATCT CCTATAGTAA ATATGACTTT TCATTAAAAA
667401 TACATCAAGA GAATATCTTA CCGCATACTG AAAGTTTGAA AAGCTTCACT
667451 CCTCTAAGAG AAAAATAAAT GAATTCAGTT TAGTTCAATT TAGTGAATAT
667501 CTATTAAATA TCCACTGTGC CAGGCAAGGT GCTAGACCCT GGGATTACAA
667551 GGGTGAACAA GACAAGATAT GCTCATTGTT CTCGAGATCA TGTTCAATCC
667601 AGTGGGAGAG AAAAACACAT ACATATTTGG TTTTAGCCAA GGTTTGAGAT
667651 CTATTTTAGA GACAAAGCCA AGTTGGACCA AGTTCTTCTC TCTATTGCTC
667701 TCAAATCACC CTTTTTTGCT ACCCACATTG ACTCCTAGCA CCTAGAATTA
667751 CAGTAACTGG CCCATAGGAT ACTCAGGGAG TGTTGTTAGA AGGAATAAAC
667801 TTGAGGATTC AGCAAGGGCC TCCTGGAAGA GATAATACGA GTCACAAAAA
667851 AACTCAGGTG ACAAAGACTA GAATGACCTT CCTGGAAGAG GAAACTGTAT
667901 AAGCAAAACA CATTAGATAT AAAACAGCAT GTTCTAGGGG TGAATTGAGC
667951 ACATGCAAAA AATAAATAAA TAAAGCAGAA TAAGGGTATG CAACTGAAGA
668001 TATGAGCAAG GGTCAGGTCT TTGTATTCAT GACTAAGACA GTGCACTTTA
668051 TTCTGTCATT GAAAATCATT GAAGTGTTTA AAACAAGTCA CAGGGTAAGA
668101 TTTGTGTTTT CACAGAAAAT TTTGTTAGAA AGTAATGTGT TGGCTTCAGG
668151 ACAGCCTGGC ACTCAGATCC TATGTTTGTC ATAACCTCGG TCTAAGTACT
668201 TGAGCTCAGC CTAAGATGAA TGGACACTGA GAGGCTTGAA GTGTATGTAG
668251 ATACAGTCCA TGAAGCAGCG CCTTGACAAC CATCGTGAAG TGATTGGGTT
668301 ACCACATAGA CAATGCGACA TGTCATTTAC TGCTCAGATC TGGGGATGCT
668351 GTGTTCTGGT GTCTGAGAGA GTCTGATGGA GCTCTGCAGC TTTTAGAAAC
668401 AGCAGGCATT ATTATATATA GCTTTCAGAA ACCCCTTCCA ATCAGGCTCA
668451 CCCTTTCTGT CAGTTAGAGG GTAAAATCCA TGTTTCTTAG CAGTCAGGTT
668501 GAGAGAGCAA AAAAAAAGAG GGATGAAGAC AAACTGAATT CCAGCTACTA
668551 ATCTCTGAGA TGCAGTATAT AAATATGCCA TATTCACTCT CTTTCATTTG
668601 AATCTGCCTT CCTGGGAAGA GACCATATGT CATAAAAAAA TTCATAGTTT
668651 CTTTTAGATT AATCTTCAGT AAGAAGCCCC AAAATATTAA ATCTCAGTGC
668701 TCTCACATTT TTCTTCTCCC CTCATAAACA ATTCGATTCA ATTTGAATTA
668751 ATATTTATCG AGTGCTAACA AAATGCATGG CAATATAGTG GATGCTGTAA
668801 TAGAACTGCT ACATAAAGGG ATAATACTCA TGTCCTACTT TAAGAAAAGG
668851 AAACAGTCTG TTTTATACGA GACAATAGGA ACAATATAGC AATAACAACC
668901 ATTGCACCAC AAGATAGGAT CAAAAGTTAT TTAATTCTGT CACCATTTAT
668951 TAACCATCTA CCATATTCAA GGAAACCAAT ATGTCCTAAA CCAAACTTGA
669001 GGAGGCTATG TTGAGGAAGA CCAGAAAAAG GAATATAGAT TTTGTTTGAA
669051 TAAGAGAACT GTGTCATTTG TAGAGAAATA GATTTGTGCT ATACCTCATG
669101 TATGAATAAA TGGGGCTGTT CCTCTCAGCC AGACAGAGGT GAATAGATCC
669151 TCATTTATTG ATTTATCTGG AGTGTTTTTG TTTGTTTGCT TTTGGTTAAA
669201 TGACCTTAGA AGTCTTTATA TGTTGCTTTA TTTTGCCAAA TTATGCTACC
669251 CAACCTAGCC CAGAATTAGG TAAAATTTGG TTCAGTTGTT TTTCCAAAAA
669301 CTCCAATAGA TAAGAATACA GGCTCTGTCA TTGCCTGGAT TCAAATCCGG
669351 ACTCCACCAC TCACTAGGTT ATTAGATCTC TTTGTCCTCC AGTTTCACCA
669401 TCTACAAGAT GAAGATAATC ACTACGTTTA CATCACATCA ATATTGAGAG
669451 AATGAAATAA AATAAGACCT GTAAAAACCT TAGTCTGGGA CTGGCTTATC
669501 GTGTTCAATG AATGTTAGCT ATTTTTCTCC TATAATAATG TGGAAGAAAT
669551 TATCAGATGC ATTCCCAAAA GCATATAGAA CTATTTGTAG AGCTTTTTTT
669601 TTTTCGTCAA GCCCACATTT TATAAACAGT AGATAGACCA ATTGGATCGT
669651 GGATAAATAG ACAGAAGATT GTAGTGATAG AGAGATAAAA TAACACAGGT
669701 GGGGTTCCCT GGGAAAGATT GTAAAAAGAT GTGCACGCAG GAACTTTGTT
669751 GGGAGGGCTC ACAGGACCAG CTTCCTTATT CCTATAGCTT CCAGAGTTTT

FIGURE 3OOOOOOO

669801 GGAAGCTGAT AGCCCTTAAC CGAATCACTC CCTAGGGAAT GCTCTTGGCT
669851 AAAGAAAGCT ACCTCACCCA AGGCCATGAC CCCTTTACAC GAGCAGCCTG
669901 AATCCAGTGA TTGAGGTAGG ACAGGGGCCC AGTCTTTCTT TCCTCAGTTT
669951 GAGCCAACTC TGAGGAGTTA TCCAGAACAT CCCATAAAAT AGATGAAGGC
670001 CTTTGGGTGA AGGCACTGAA CTGTAACCTG CTGCTGCCCA ATCCTGCTTT
670051 CTTCTCTTCC TCAGAGGTAT TGATGCTGAG AGTGTCTAAT CAAAAATCAT
670101 GATTTAATGA AACTCATAAG ATTTACTGCT TCACCAAGGA CATTCTTAAG
670151 AAAACCTAGC TTTTTTTTTT TTTTAATCTT TCTGTGAGTG CCTGTGTCAG
670201 AGAAGAATAT GAGAATACTA GTATAGCTTG GTTTGGTGCT GACTTGATTC
670251 CTGATAAGAC TCCTGCAGTT TTACCCATCA GAGTTTTGTA CCATTTGTGC
670301 AAATATCAAC CTAGTGAAAA AAGGCAAAAA CATGTACTTA GTGCTATTAT
670351 GAAAATAATT TTGACCTCAT GGACCCCTGA AAATGTCTTG GCCAATGGAT
670401 TAGAAGTAAA TATCCTACAT TTATAGTCCT ATAAAAGAAC ATAAAGAAAG
670451 TAGTTTAGAT TCTTTTAATA CACCAAAATC TTATTTTTAA AATGATACCA
670501 CTTACCATTA TTAGAACCGT TATTACCATG ATGATTGAAA TGAAAGCAGT
670551 TAATCTAAAT CTTCAAATGT TGGTGACAAA AATATTTTAA GGTTAATTTT
670601 TAAAATAACT TGCATAATAG CCAAAAAGTA GAAATAAGTC AAATATCCAT
670651 CAACTGATGA ATACACAAAA AGAGTAGAAA TTATCCAGCA ATAAAATGAA
670701 TAAATTACTG ATACATGCTA CAATGTGGAT GAACCTTGGA AACATACTAG
670751 GTGAAAGAAG ACAGTCACAA AAGACCACAT ATTGTATGAT TCCATTCAAG
670801 AGATATCCAG AATAGGCAAA TATATAGAGC TAGAAAGTAG ACTACTGGTT
670851 GCCCGGGGTG GTGGGAGGAG TTAGGAGAAG TGAGGAGTTA TTGCTAGTAA
670901 AGATGGGCCT TTTCAGAGGG GATGACGAAA ATGTTCTAGA GTTGATTTTG
670951 GTGATAGTTG TACAACTCCG TGAATAAGGT AAAAACTCAA TTGTATACTT
671001 TAAAAGATAC ATTGTATGGT ACACAAATTA TATTTCAATA AAAGTATTAA
671051 AAAACAAATT GGTGCTTTGT GACACACTCG GCATAGATAG AACATTAAAT
671101 TTCAACCTGG TCTTAAGTAA CTATTTCTCA TCATATATGT AGGAGCATAT
671151 GTTGAGAAGT GATTTTTCAG AAAAGTGAGA AGGGAATTTT CTGACTCATT
671201 AAAATTGCAA AAAAAAACAC ATATAATAAC AGTAATAACA AGGACTAACT
671251 ATTATTAAAT TAAGTGAGGA GCTGTGCTGT CTGCTTTATA TGTGATTCTC
671301 CCTGCAATTC CAAGTTAGAT GACTCTATTC TCATCGTGTA GATAAGGAAA
671351 CAGACACTCG AGTTTTCAGG TGCCCCATTA ACATTCACTA CTACTTTAAA
671401 ATTCTGCTTG ACAAGAATTA TGATAGGAGG CAACTCCATT TTTGAATAGG
671451 TAAAAAAGCC AACTTTTAAA CTTCAGTGTA CTTCATTTTA GGTCGAAAGA
671501 ACTTATACTT TCAATTCCAC TCAAAGGTTT CAAGATTCCT AATAGAAGAG
671551 TGGTAGGTAG TGTACATGAT AGAAGAGGCA GATTTCATCT AATAGTGTAC
671601 TGTCTAAGAA GATGGATTTG AAACAGAAAG AGCTAATAAC ATCAAAGATT
671651 TTCTTTGCTA GGTCATCCTT TATACATTAA TTATACAGAA GTGCCGGCTT
671701 AAATGGATAT TCTTGCTCTA AGAGTGTTTT TTTAAGAGAG GGTTCTTTCC
671751 CTTACTCTGC ACTTGAGTTG GGAGATATTA TCAGAGAGCT ATCAGAGAGA
671801 TAAGTTGATA GAGCAAGACA AAGTTTATTT CATTTGTAGT ATAAGCTTAT
671851 TCATTTACCT GAACAATGAA TCATCATTGT ATAAGAGACT GTGTCACCAT
671901 GACAGCTAGG GTAAGATCAT CTCTGTCCTG AAGCTGCACT ATGGTTTGAA
671951 ATCAGATATG TATTCATAAA ATCTGCTTTA ACTTTTAAAA TTTATAAGTT
672001 TCTCTTATTT GTGCTTCTAA TGTATAACAT AAAGTAATAT AGCCCTACAA
672051 TCTACTGCTA GATATTCATT TTTAATATCA TTCATAAATA AATGTTGCAT
672101 GATGTATAAA AAAAAGAATT TTTCATGTTG CTCTATAACT CCATTAAAGA
672151 CAACAATCTC CGAATAACTA GGTAGAATAA TATGCATTAT TTTTCACACT
672201 TAAAATATTT TTATTTTTAT TTCCTCTAAT TTCAAGGGTA CTATTTGTTT
672251 ACTATTTGTA TCTGGTCTTG TTGGTGCATA CATTTTGCTC AGATAACAAT
672301 TGGGTATTTT TTAACTCTTT AAAATGAAAA CATTATTTTA AAATCAAGGT
672351 GGAGGGAATA AGATGGGATT GATTAGTTAA ATGGGATTGA TACTGATACC
672401 ATGCCTGACT CATTCTCCAC ATCATTTAAT TTAATCCTTC CAATCAGGAG
672451 CTAAAATTGT CTCATTTTTC TGTCAATTGC TAACAACTTT TCTGTCTTCC
672501 CTGTATAATG AAAAAAATGG AAAACTCTAT TTCTTTTCTG TTTGCTTGTG
672551 CTTTTTTTCA TTCTGCTGCT TTCCTATACT TGTTTCTTGT TTATACCATC
672601 ACTTTTTTTT TCCTGAGTCA CCTGTCCTGA CTACTATTTT TCACAGTATC
672651 TCCAGTTATC ACACGGGTTT TATCCAGTCC TAGGTTTTGC TGCCCTTCTA
672701 CCCAGCTGTA CAGCTGGTTC AAAGCTCACA GCTATGGAAA GTGGATTCTA
672751 TTTGTTTGGT AGCCTTTTTT TTGGCAGACT TTGCTCTTAC TTTATTTCAC
672801 TTTAGTTCTC TCCTATTACC TAAGCTTTTG AAATAATTTT GTTCTGAGAG
672851 TTAATTTGGT TGGTTTCCTT CTGTCCTTTG TTTAGTTGTC CTTCACTACT
672901 TCCAGTTAAA TTTTCCCTTT TCTTTAAATG TCAAACAAAT TATTACTTTT
672951 CCTTATGAAT ATAGTCAGTG ATCACCAAAG TTGATGCTTA TCTTCATTTG
673001 ATCCAATAAA ATAAATATAA GGATCTTATT TAATACACAC ACGCACACAC
673051 TGCATTAAAA TAAATCAATT TACACAATTG TGATTCTCTT GCAGAAGCAT
673101 GATGGCCACT TCACAGTCAT CCAGTTGGTC GGAATGCTCC GAGGCATTGC
673151 ATCAGGCATG AAGTATCTTT CTGATATGGG TTATGTTCAT CGAGACCTAG

FIGURE 3PPPPPPPP

673201 CGGCTCGGAA TATACTGGTC AATAGCAACT TAGTATGCAA AGTTTCTGAT
673251 TTTGGTCTCT CCAGAGTGCT GGAAGATGAT CCAGAAGCTG CTTATACAAC
673301 AACTGTAAGT TTATATGCCC TTTCCTAATA TAGTCTGTTT ACTTTTATTG
673351 TTTTTAATGT CATTAGAGTA ATTCTGTTTC TGCCTTCCTA ATTTTCTGCT
673401 TGTATTTATT ACTTTGCTAA TTTGATATCA TTATTTAATT GAGAAGTATT
673451 TGCTTTGAGT GTCTAGTTTA TAACAACAAC AACAAAAAAG AAAACAAAAA
673501 CTTTCATACC TGACTGTTTT CTTTCTTTCA TTGTCCTGGG ACTTTAACAT
673551 CATGCTTAAC GTCCATGTCA TGACTGGATG TTATAACATG GGCTGAAGTA
673601 TCTTTGATGA TTTAATAATT TTATTTAAAT AGAGTTCTGT GTATCTAAAT
673651 GGTAGAATTA ATTACTACCT CAGTAATATG AGGAACCAGT GATTCTGAAA
673701 TGACTTTATT TCCAAATGGT TTTGAATGAT CTGATCATAC TTATAAAGAA
673751 CAATATGGGT TTCTTTGGAG ATATATAAGT ACACTCTAAA CCTTTTCCTA
673801 AATGATACTT GGAGAAAATG TGAGCTGAAA TGCAAATTTA AAACTTTAGA
673851 ACCAAACCGT CATCCACAAA TTATATCAGT TCAATTTGTC CTATGGATAG
673901 TGTAAATATT TCTGACTGTC CTAAACCAAT TCATTTCACT GATCTCCTTG
673951 GTTATTGTTT TGAGAAATTT GGTCTCAAAG TCTCTGTTGT GCTATCTTCA
674001 AGCTACTAAT TCATAAAGTT ATATTCTGTT ATTTTTTTAA ACAAACCTTC
674051 ACCACTAACT CATTTGGCAG TCAGTTTCAA TGAAAAATAA GTTATTAAAG
674101 CTACTCAAAA GATTTTTATT ATATTCTTAT TTTCTCACTT TACACATTAT
674151 TTTAAAAGAT GCAACTTCAT TATTGAGTCC TTTTTTATTT CATGCTTTAT
674201 GAGTTTTTTT GAAACTTTGC TGTATTCAGT TACTCCAGAA TAAAATGCAA
674251 GTTTAATATT GTGAAAGGAA TATTTTATGC CTTGCTATAT TTGCTTTGTA
674301 GAAATGTTAT CTATTAATTT ATCAATGATA TTTTTCACAG TTTCTTCAAC
674351 AAAGAAATAT AGTTCTAAGG AAAATAAATT AACCTTTCAT TGTCTGATAT
674401 ATAAAGTAGC AGTGTAGGAG TATCTACTGA TCTTTTAATT TAACCAAAAA
674451 GCTTCATAAA AATAAAAGTC TATCAGTTCT GAAAACAATT TGTGCAGTTT
674501 AGAAAAAGCA GTATTTTCAA CTCCATTTTT AAATTGGAAA ATATCATAAT
674551 TATTTTCATT TTTCTCAAGG CCTTTATTTT CTTTTATCTT TACAAATTTA
674601 TAACTTAAAA CAACTTTTGA AGTTATAGAA CAACGAATAT AAAATTTTTC
674651 CATTAAGCAC ATTATTTCTA ATGCTGAAGA ATAATGTTGA AAAGTGTTAT
674701 ACAAATATTC CAAATGTAAT ATTTATAAAA ATTGCAACAA ATACAATCTA
674751 CTAAAAAATA AAATATGATG GGAAATTACT ACACTCTTTG TGGCAGTAAG
674801 CCTATATAAA TAGACTTGAA ATTTAATAAA ATAATATTTT AACTGCTTTT
674851 TAAAATGGTA AGCTTATAAC TAAATGTAAT ATACTCATGA AATTGGCAGA
674901 TAACTGAAAT TTTTATGCAT ACGTAAGTTT TGTTACATCA AATTTAACAA
674951 CCAGACTCTT GGCATTTTCT GTCTTATGTG ATTCTAAAGA CTAAGAGGCC
675001 TAGGACAGTG CTTTTTAAAA TTTAGATTGG ACCCCAGACT TAAATAGCAA
675051 ATTAGGTAAC CAGAATATTA ACACTCTAAA AACTGCCTTT GAAAAGCTGT
675101 AGATTATGTC TTGATTAAGA AATAAGTCTC TGAATTTAGA AGGTATCAAT
675151 TAAATGGCAA ATAATATAAT CAAGTTTTTT TTTTTTAAGT CTCAGAACTA
675201 CTTACTGTTC AGAGGACTGA CTTTATAATG AACATGGACA TTCAGCACTT
675251 AAAATAGTAA AGCTCTTGCC TTTAAAGACT TTATACTTTC ACAGGTTAGA
675301 AGGTTCATGC TGCCTTGCAA TTCAATACAG TAAGTGTGGT CATGGGGGTC
675351 TTAAAAAGAA CTACAGAAGT ACCAAAAAGC AGAGGCTGAA GAAGGCGTCA
675401 CAAAAAGTCA AAATGTGAAC CAAATCTTAG GAGAATTTAT TACGCTGACA
675451 GTTGGAGGAA AGGTAGTCCA GATGGAGAAG AAGAAAGAAA AAAGACATGG
675501 AAATGCAAAA AAGTGAATGG GCCTATCGAT GAAAATTTGG GGCCATAGGC
675551 AATGGAGGGG CCAATTTTCC TGGAATAAAT GTAAAGGTAC CTGAGTGGCA
675601 CTCCAAGAAA TTTGAAGGTT TTTGTATAGC AACTAGGAGA CAGGCACTGA
675651 TTTATTTAAA CAGGAAATAA CAAACATAGA CGCATGTCTT AGAAGATATT
675701 ATTGGGGCCG GGCACGGTGG CTCGCGCCTG TTATCCCATC CCAGCACTTT
675751 GGGAAGCCGA GGGGAGCGGA TCACCTGAGG TCGGAAGCTA GAGACCAGCC
675801 CGACCAATAT GGAGAAACCC CATCTCTACT AAAAATACAA AAAAAAAAAA
675851 AATTAGCCAG GCGTGGTGGC GCATGCCTGT AATCCTGGCT ACTCGGCAGG
675901 CTGAGGCAGG AGAACCGCTT CAACCCAGGA GGCGGAGGTT GCGATGAACT
675951 GAGATCATGC CATTGAACTC CAGCCTGGTC AACAAGAGTG AAACTCCATT
676001 TCAAAAAAAA AACAAAAGAT ATTATTGAAA CAGTGTAAAG AAAGGAAGGA
676051 GAGTTTGAAG GACAGGAGGA CTAGTAGCAG ACAGACCAGT TAGGCATTAT
676101 TGCAATAAAC CAGAATGGTT ATATGACTTT AATTAGGGCA ATGACAGTTG
676151 GAATAAAGAG GAGGAGAGAG AAATAACATA AATTAACATG TTCATTATAT
676201 GTTCATTATG ATTCAATAAT TAATTGGATA TTAATTGTAA GGAAGAAGGA
676251 GGATTTAAAG ATGGCACTAA TATTTCTAGA TTGAACAACT GGTTAAATGG
676301 AGATGCTGTT AATCAAGACA GAGAATCCCT ATTAGAGATG ACCTGGCTAA
676351 TGGTATTAGA TTACAAAGCA AAATTATAAA AGAAGATATT CTATTATAAC
676401 AAAATTATAA TAGACAGATA TTCTGTCTCA AAGGCAAGAT AATGCCAAAT
676451 GATCATTGGC ATTCTGTCAA AACTTTGTTT ATAAATTTTA GAGCATTCTA
676501 TGAATGTACT TAGCCCCCAA ATACTTTTCA CATTTCCTCT TAAAAAGAAT
676551 GAAATAGTTA GAAACCTGCC TACTGAAGAT ACAAGTCAAT TCAAGCAAAC

FIGURE 3QQQQQQQ

676601 CCTGTATAAT AAAATACAGA GGAAGAATGG TCATTTATAT GAAAAGGGTG
676651 GGGGAGGAGC CAAGATGGCT GAATAGGAAT AGCTCCGGTC TACAGCTCCC
676701 AGCGTGAGCG ACGCAGAAGA CGGGTGATTT CTGCATTTCC ATCTGAGGTA
676751 CCGGGTTCAT CTCACTAGGG AGTGCCAGAC AGTGGGCGCA GGATAGTGGG
676801 TGCAGCGCAC CATGCGCGAG CCGAAGCAGA GCGAGGCATT GCCTCCCTTG
676851 GGAAGCGCAA GGGGTCGGAG TTCCCTTTCT GAGTCAAAGA AAGGGGTGAC
676901 GGACGCACCT GGAAAATCGG GTCACTCCCA CCCGAATATT GCGCTTTTCA
676951 GACCGGCTTA AAAAACAGCG CACCACGAGA TTATATCCCA CACCTGGCTC
677001 AGAGGGTCCT ATGCCCACGG AGTCTCGCTG ATTGCTAGCA CAGCAGTCTG
677051 AGATCAAACT GCAAGGCGGC AGCGAGGCTG GGGGAGGGGC GCCCGCCATT
677101 GCCCAGGCTT GCTTAGGTAA ACAAAGCAGC CAGGAAGCTC GAACTGGGTG
677151 GAGCCCACCA CAGCTCAAGG AGGCCTGCCT GCCTCTGTAG GCTCCACCTC
677201 TGGTGTCAGG GCACAGACAA ACAAAAAGAC AGCAGTAACC TCTGCAGACT
677251 TAAATGTCCC TGTCTGACAG CTTTGCAGAG AGCAGTGGTT CTCCCAGCAC
677301 GCAGCTGGAG ATCTGAGAAC GGGCAGACTG CCTCCACAAG TGGGTACCTG
677351 ACCCCTGACC CCCGAGCAGC CTAACTGGGA GGCACCCCCC AGCAGGGGCA
677401 CACTGACACC TCACACGGCA GGGTATTCCA ACAGACCTGC AGCTGAGGGT
677451 ACTGTCTGTT AGAAGGAAAA CTAACAAACA GAAAGGACAT CCACACCAAA
677501 AACCCATCTG TACATCACCA TCATCAAAGA CCAAAAGTAG ATAAAACCAC
677551 AAAGATGGGG AAAAAACAGA ACAGAAAAAC TGGAAACTCT AAAAAGCAGA
677601 GCGCCTCTCC TCCTCCAAAG GAACGCAGTT CCTCACCAGC AACGGAACAA
677651 AGCTGGATGG AGAATGACTT TGACGAGCTG AGAGAAGAAG GCTTCAGACG
677701 ATCAAATTAC TCGGAGCTAC GGGAGGACAT TCAAACCAAA GGCAAAGAAG
677751 TTGAAAACTT TGAAAAAAAT TTAGAAGAAT GTATAACTAG AATAACCAAT
677801 ACAGAGAAGT GCTTAAAGGA GCTGATGGGG CTGAAAACCA AGGCTCGAGA
677851 ACTACGTGAA GAATGCAGAA GTCTTAGGAG CCGATGCGAT CAACTGGAAG
677901 AAAGGGTATC AGCAATGGAA GATGAAATGA ATGAAATGAA GCGAGAAGGG
677951 AAGTTTAGAG AAAAAAGAAT AAAAAGAAAT GAGCAAATCC TCCAAGAAAT
678001 ATGGGACTAT GTGAAAAGAC CAAATCTACG TCTGATTTGG TGTACCTGAA
678051 AGTGTTGGGG GAGAATGGAA CCAAGTTGGA AAACACTCTG CAGGATATTA
678101 TCCAGGACAA CTTCCCCAAT CTAGCAAGGC AGGCCAACGT TCAGATTCAG
678151 GAAATACAGA GAACGCCACA AAGATACTCC TCGAGAAGAG CAACCCCAAG
678201 ACACATAATT GTCAGATTCA CCAAAGTTGA ANNNNNNNNN NNNNNNNNNN
678251 NNNNNNNNNN NNNNNNNNNN NNNNNNNNNN NCACATAATT GTCAGATTCA
678301 CCAAAGTTGA AATGAAGGAA AAAATGTTAA GGGCAGCCAG AGAGAAAGGT
678351 CGGGTTACCC TCAAAGGGAA GCCCATCCGA CTAACAGTGG ATCTCTCGGC
678401 AGAAACCCTG CAAGCCAGAA GAGAGTGGGG GCCAATATTC AACATTCTTA
678451 AAGAAAAGAA TTTTCAACCC AGAATTTCAT ATCCAGCCAA ACTAAGCTTC
678501 ATAAGTGAAG GAGAAATAAA ATACTTTACA GACAAGCAAA TGCTGAGAGA
678551 TTTTGTCACC ACCAGGCCTG CCCTAAAAGA GCTCCTGAAG GAAGCGCTAA
678601 ACATGGAAAG GAACAACCGG TACCAGCCAC TGCAAAATCA TGCCAAAATG
678651 TAATGACCAT CCAGACTAGG AAGAAACTGC ATCAACTAAT GAGCAAAATC
678701 ACCAGCTAAC ATCATAATGA TAGGATCAAA TTCACACATA ACAATATTAA
678751 CTTTAAATGT AAATGGACTA AATGCTCCAA TTAAAAGACA CAGACTGGCA
678801 AATTGGATAA AGAGTCAAGA CCCATTCAGT GTGCTGTATT CAGGAAACCC
678851 ATCTCACGTG CAGAGACACA CATAGGCTCA AAATAAAAGG ATGGAGGAAG
678901 ATCTACCAAG CAAATGGAAA ACAAAAAAAG GCAGGCGTTG CAATCCTAGT
678951 CTCTGATAAA ACAGACTTTA AACCAACAAA GATCAAAAGA GACAAGGCCA
679001 ATACATAATG GTAAAGGGAT CAATTCAACA AGAAGAGCTA ACTATCCTAA
679051 ATATATATGC ACCCAATACA GGAGCACCCA GATTCATAAA GCAAGTCCTG
679101 AGTGACCTGC AAAGAGACTT AGACTCCCAC ACATTAATAA TGGGAGACTT
679151 TAACACCCCA CTGTCAACAT TAGACAGATC AATGAGACAG AAAGTCAACA
679201 AGGATACCCA GGAATTGAAC TCAGCTCTGC ACCAAGCAGA CCTAATAGAC
679251 ATCTACAGAA CTCTCCACCC CAAATCAACA GAATATACAT TTTTTTCAGC
679301 ACCACACCAC ACCTATTCCA AACTTGACCA CATACTTGGA AGTAAAGCTC
679351 TCCTCAGCAA ATGTAAAAGA ACAGAGATTA TAACAAACTA TCTCTCAGAC
679401 CACAGTGCAA TCAAACTAGA GCTCAGGATT AAGAATCTCA CTCAAAACCG
679451 CTCAACTACA TGGAAACTGA ACAACCTGCT CCTGAATGAC TACTGGATAC
679501 ATAACGAAAT TAAGGCAGAA ATAAAGATGT TCTTTGAAAC CAACGAGAAC
679551 AAAGACACAA CATACCAGAA TCTCTGGGAC GCATTCAAAG CAGTGTGTAG
679601 AGGGAAATTT ATAGCACTAA ATGCCCACAA GAGAAAGCAG GAAAGATCCA
679651 AAATTGACAC CCTAACATCA CAATTAAAAG AACTAGAAAA GCAAGAGCAA
679701 ACACATTCAA AAGCTAGCAG AAGGCAAGAA ATAACTAAGA TCAGAGCAGA
679751 ACTGAAGGAA ATAGAGACAC AAAAAACCCT TCAAAAAATT AATGAATCCA
679801 GGAGCTGGTT TTTTGAAAGG ATCAACAAAA TTGATAGACC ACTAGCAAGA
679851 CTAATAAAGA TAAAAGAGGG AAGAATCAAA TAGACACAAT AAAAAATGAT
679901 AAAGGGGATA TCACCAACGA TCCCACAGAA ATACAAACTA CCATCAGAGA
679951 ATACTACAAA CACCTCTACG CAAATAAACT AGAAAATCTA GAAGAAATGG

FIGURE 3RRRRRRRR

680001 ATAAATTCCT CGACACATAC ACTCTCCCAA GACTAAACCA GGAAGAAGTT
680051 GAATCTCTGA ACAGACCAAT AACAGGAGCT GAAATTGTGG CAATAATCAA
680101 TAGTTTACCA ACCAAAAAGA GTCCAGGACC AGATGGATTC ACAGCCGAAT
680151 TCTACCAGAG GTACAAGGAG GAACTGGTAC CATTCCTTCT GAAACTATTC
680201 CAATCAGTAA AAAAGAGGGA ATCCTCCCTA ACTCATTTTA TGAGGCCAGC
680251 ATCATTCTGA TACCAAAGCC GGGCAGAGAC ACAACCAAAA AAGAGAATTT
680301 TAGACCAATA TCCTTGATGA ACATTGATGC AAAAATCCTC AATAAAATAC
680351 TGGCAAAACG AATCCAGCAG CATATCAAAA AGCTTATCCA CCATGTGAAA
680401 GTCAATGTGG CGATTCCTCA GGGATCTACA ACTAGAAATA CCATTTGACC
680451 CAGCCATCCC ATTACTAGGT ATATACCCAA AGGACTATAA ATCATGCTGC
680501 TATAAAGACA CATGCACACG TATGTTTATT GCGGCATTAT TCACAATAGC
680551 AAAGACTTGG AACCAACCCA AATGTCCAAC AATGATAGAC TGGATTAAGA
680601 AAATGTGGCA CATATACACC ATGGAATACT ATGCAGCCAT AAAAAATGAT
680651 GAGTTCATGT CCTTTGTAGG GACATGGATG ACATTGGAAA TCATCATTCT
680701 CAGTAAACTA TCACAAGAAC AAAAAACCAA ACACCGCATA TTCTCACTCA
680751 TAGGTGGGAA TTGAACAATG AGATCACATG GACACAGGAA GGGGAATATC
680801 ACACTCTGGG GACTGTGGTG GGGTGGGGGG AGGGGGGAGG GATAGCATTG
680851 GGAGATATAC ATAATGCTAG ATGACGAGTT AGTGGGTGCA GTGCACCAGC
680901 ATGGCACATG TATACATATG TAACTAACCT GCACGTTGTG CACATGTACC
680951 CTAAAACTTA AAGTATAATA AAAAAAAAAG AAAAGGATTC TTTGTTTTAT
681001 AAGAACATCT GCATGAAAAT AGCTTTAAAG AGAAAATTCC CTTGATACGT
681051 ATATATTTTA CGTATAATTC AGTTTTTTTA AGTTGTATCT ATATATAACT
681101 TTCTTTGAAC GTATATTTTA CCTCAGATGA TTTTGACTTT TTCTCTTGCT
681151 GTGTAACTAT AATTGCTATT TGCTCATTAT TTGTAAATGT TTTTTATAAT
681201 CTGTGTCAGG AAGGATTTGG AGGAAAGAGA GGCTGCGAGG GCTTAAAAAT
681251 AAGAAGACAT GATAGATAAA GGTTGGGTTT TGTGGGGCAG TTGTTGGGGA
681301 GAGGTTTGTA ATCTTCAAGA AAAAAATATC TTTAGAACAG TATGCTACAT
681351 GGAAGCTATC CTTTTCTAAT CAAAATACGG ACAGAATAGG CATTTTCCAT
681401 TAAAATGACT TTGCCAATTC AGAGACCCAC AAATCACAAC AAAGAGCAAT
681451 CAGAACTGGT TAAAGAAGAT GGTCTGGAAA GCTTGTGTGA GCAGTGCGAG
681501 TCCAGCTCTG GTTATGGTAC TGGACTGGTC CTCATGTGGA AGAGAAACAG
681551 AAGGGCCATG GGAGCCAGTG GCCAGACCAG AAAGCAATGT GACAAGAGAG
681601 ATAACCCTCC AACAGTGAGT CTTTCAGAGC CCCGTTTAAA AATCCTATAC
681651 ATGTAATATA TAAGACAGTA TTGTCCACAT TTCAAAATAC ACTAAAGTAA
681701 ATGAAGAATG AGATTTACAC CTAAATATAA GTAGAAATTC TAATATTTTC
681751 TTCTTCAACT TGAGTGTTTT GCATGCCGTG CTCTAGGTCT GACATATTCA
681801 TTCACTGTGT ACTTTACACA GTTTATTATA GAGCGACCAT ATTTCAGGCA
681851 CTATTCTTTG GAGGGCCAAT TGTGAAACAG CTTCGCTAAT TATCAGTCCC
681901 AAAAAAGGAC TCCCATTCCA TGAGGAAAAC AGCAAAAGAT CAATCATCAC
681951 TATGCCAGCC ACCAGAAACA GGAGTCCATA TGTACTTATG CCCACTGCAT
682001 CCTGAGCTAC TGTGTAGGTC CACCATGCAC TGGGTACCTA TTTGCCAAAA
682051 TCCAGTGAAA GAAAACATAT TCACAAGTTA TGTGAAATGG GTTTACTTCT
682101 TATAGATAAT TAGCAAGGGA CAGAAGTCTT GGATCCATTG TGTGTGGTTC
682151 CTCCAAGGCT GAAGAAAGCT GAACAGGAAA GATGTAGTCT TGATATGAAT
682201 GCTCCACTTT CACAGCTGAG GGACCCTGAA AGGCAGTCCA CTCTGGATTA
682251 TGTACTTCAG GGGCCACATG ACATACTGGG CAAAGCTGTA AAGGACATCC
682301 AGCTTCCAGG GAAGAGAGGA ACAAAACTCA GTCTGTCCCA TGCAGTTCCT
682351 TCGTAACTCA AGCTATTCAA TTTCCTAGGA GGGACAGGTT TCAGGCAGTT
682401 TCTCCCTATC TGAGGATATT GCATTCCCAG CACATTGTAC TGTTATTCTT
682451 CAGAACTACA AGCAAGAAAG CAAAGAGAGC TGGGTTGGTC CAAGGCCACT
682501 CAAAGAACTC TACTGCACCA CCAACCAAAA ACAAAGGGAT TATTGAGAAC
682551 AGATAAATGG CTACACAGGA ATAAGACCAA GGGTAACCAA ATAAGGCATA
682601 TAGTAAAACT CATATATTGT ACAGACACCA AGAGTCGACA GCACAGCATG
682651 AAAGGCAACA AGAGTTGTAG CAGAAGGTTT TTCTGGTATA GTATGTAAGC
682701 CCTGAACTAA AATACATCAA GCTTTTTCAA AGAAACTTTA AGATCTGATA
682751 ATGGCATGAA AACCAAGAAA TGTGTATTGT GGGCCAAGAT AGAAGGAAAT
682801 AAATGCACAA AAATAGGATT TAGATGAGAA CTGAGGCCTT GTTTTTACAT
682851 GCCAATTCTA TGATGAGATT ACAAAGCACT TATGAGAGAT TAGTGAATGA
682901 TTAGGGTCCG CACCTAACAA TACATATATA ATTAGTGTTA TGTGGCTAAA
682951 TTAATCTGCA TAAAAGTTAC TGACAGTTCA CATTGTTTCC ATCTGATTAC
683001 ATGGTCTCCT GTCTGGTTAT AATTTAGGTG CTAAGAAATC ACTGCCTTTT
683051 CTGAGTTTGA CACACATTCA CATGGACAAC TGTTTTATAA CCAGTTCCAG
683101 AGGAGGGACT CTCTCATTTG AATATTGCTA GGCAACCCAG TCTTAAACTT
683151 ACATTGAAAA TGCTAAGCCT CTTGGCTCTC AATTATGGAA ATGAGATCCT
683201 ATTTACCTAA AAAGAACATT AAAAGATATA TTATGGTGCA CACTCATCCA
683251 TTTTAAGAGA TAGGTTTCAT TTAAAATATA ATGGCAGTAA ATGTTCAGAT
683301 TTTTAAAAAA ATTCTCATGA GTAAACTTCT TTTATTATAT TTTGAAGATC
683351 AAAGCAAAAT AGAAGAATCA TTTATTGCAA TACTCGTTAA AAATTTTATG

FIGURE 3SSSSSSSS

683401 AGTCCTTGAT TTTAACTTCT AATTGCATCG ATTTTGTGTT ATCCATGGCA
683451 AATTTTGGTT TTGTTTGTCT GACAGCAGCA ATTCAGTCGA AATACTTTGT
683501 TGAAATACAG AGCCTCATTA TTGACAATAT ATAATCTGCA TAATTACAGT
683551 TCTGTTAACA TCTTAATTCT GTTTACTTTG CATTCATAGG ACCTCTTCCA
683601 AACTCTAACA CTTAACCTCT GCTATTCTGC ATAAATTCTG AGAAAAGCCA
683651 AATTTTCTGT CGGTCTAAGA AGACATAGCC TACACCCAAC TGGAGATAAT
683701 TATAAAAAAT AATGAAGCAG CATGAGGGGA AGGTATTTAA TGTGTATTTT
683751 AAAGTTGGGA GAGATTCTCC TTCACCTAAT TTAGGTGTTT GTGAATTGGC
683801 TTGACTTTTT GAAGTTAATT TTTAAGCCTT GAACATGTCC AACTTTAAGA
683851 ACTTTAAGAA TAAATATTTT AACACAAGTG AGATCTGCCT TTAAGTACTT
683901 TCATTAACAT GAGTAAATGG GATTCGTCTG GAGATCATGC TTAACCTTTT
683951 AGTAAAACAT ACTCAGAACT TTCACTCACT TTGTCTCTTA AATTAAAGAG
684001 TTGGTGTAAA AAGTTTGCAG CGAGAAAAAA GATTAAAGGT TTCAATTACA
684051 ATTATATAAT AACCAATGCA CTGAATAAAA GGACTCACAC TGAAAAATGT
684101 TACTGATTTC TCGGATTCTA AAGAATAAAA CTTTATCCAT TGAAATTCTA
684151 CCACAGGATT CTCTGTCATC AAGTCACTGC TGGTGGAGCT GACACTGTGC
684201 TAAGATACAA TACGTGGTAA AATGCATTTT ACTCTAACTC TACCCTAGTT
684251 CAACTGGGTC TAAGCCGAAA AATTACTTAC ACTCAATTTT TCTTTAAGAC
684301 TTGACCAAGC TAAAAATGGA GGGGGTTTGA CTGCTTTAGG CACAAAACAG
684351 GCACTTAGGT AGAAAATCAT GAAACCAACC GTGTTAGTCT GTTTTCTCGC
684401 TGCTAATAAA GACATATCTG AGACTGGGTG ATTTATAAAG GATAGAGGTT
684451 TAATTGACTC ACAGTTCCGT ATGGCTGGGG AGGCCTCACA ATCATGGCAG
684501 AAGTGAAGGA GAAGGAAAGT CACGTCTTAC ATGGTGACAG GCAAGTGAGA
684551 GCATTTGCAG GGGAACTCCC ATTTATAAAA CCATCACACC TTGTGATGGT
684601 CACTACCACG ACAACAGTAT GGGGGAAACC ACCCCATGAT TCAATTATCT
684651 CCACCTGGCC CCACCCTTGA CACGTGGGGA TTATTACAAC TCAGGGTGAG
684701 ATTTGGGTGG GGACACAGCC AAACCATATA ATCTACTAAC ATAGAAAAAG
684751 CTACATATAG CAGCATATAT AGAATATAAG AACAAGCTCC TTCAGAGAAT
684801 TCACTGGGAA ATTCAAATAA AGGAAATGGC ACTTTTTTTA GGCAAACCTA
684851 AATTCAGCCA CATAAGAATA AAGAAAAGTG AGAAAAATAG CAGCATTATC
684901 AGAATGCTAT GATGTGAAGA TTTAAATAAC TTATTTTTCA GTAAAAAAGG
684951 TGATAAGTAA ATAAACCTTG GAAAAGTGAA AAACAACAAA AATCCAAGCT
685001 GGATAAACCA AATTCATCTA TTAAGAAAAG AGCTATGCCA CTTGGGAAAA
685051 AACAACAAAA TCACTATTCA CACACACACA CACACACACA CACACAACAA
685101 TAGTTCTATG ATAGATGCTA TGCTAGTAGT CAATCAAAAC CAGTCAAATG
685151 TATTGACCAT TATAATTCGC TGATGAGGAA GAAATCGATG CGCTAATACT
685201 AGGTTTCCTA AATTCACAGG AAAACAGTAC TCTTGATCCA GCAAATGTTT
685251 GATAGATTAA TTCATGAAGA GAAAATCTGA CAGTTTTTAT ATACTTTCTT
685301 CAATATAAAC TTTTTGTAAA GGATACTCTA ATCATCTAAT ACAAAAGATA
685351 TATTCTTAAA AATTAGTAGT CTCCACATCT TGAGCCCATT TGTCAGAAAG
685401 CAAATCCACA ACAATGGAGA TGGAGGAGCA ACACACATAA CAAACGGGAG
685451 AGAATATGTG CTAAATGCAT GGTAAAAGTC TTCTCCAATA ACTGTTTGAG
685501 GTGTGAACAC CATAAACATC AGCTTGGATC ATAGGCATAG AGACCCAGAA
685551 TCTTAATGGT ACTTGTCTGG GATGGTAGTT TCAGAAGGGC ATGAAACTCT
685601 TATGAAATAT ACTGCTTAGG TGAACTGACA ATGGCAGATG TTAAGCATAT
685651 GATGGAAAGT GGGGATTAAT GCAATACCAA AGGAAATTAC TGCATAAAGA
685701 ATTATTTCCT GAAAAGCCCT CATCTATGAA GCTTAGGAAA CAACAGTTTG
685751 CGGTCATTAC AGAGTGATTT TTAGTAAAAC AAATGAAAAA GATTTTAAGA
685801 TTATCATACA CAAAGGAAAA AATGATTGAT AAAATGGTAG CTTCATCAAA
685851 AATTTTGAAA ATAGATCCAT CTGGCTCAGT CATATATACT ATTAAGAAGG
685901 CAAGCCAAAC TTTGAGAAAA CCTCTATATT TTATTTGTAC AAATCACACA
685951 CAAAAAAGAA CCTAAAAAAC AAAAACAAGA AGTCCTTGTT ACATGTAATA
686001 AGCCTTTTGT CTCTTCAATA TGTGTTTTAA AGAAGAGGAC TCTACTCTTC
686051 TTTAAGAGGC TGAGGCAGGA GAATTGCTTG AACCTGGGAG GCAGAGGTTG
686101 CAGTGAGCTG AGATTGCGCC ACTGCATTCC AGCCTGGGCA ACAGTTCAAG
686151 ACTCCATCTC AAAAAAAAAA AAAAAAAAAG GAGAGGACTC TAAGAAATAG
686201 ACCTTGGAAG TCATCATTAT TTAACACAAG AGAATACTGA GAAACTCCAA
686251 CTTTCTTTTC AGCACTCAAG ATTTGGTGTG TCACTTGCAA GTGGTTATTT
686301 TGTTTCGATT TTGTCCTAAG ATAACATTTG CTATAGATTT GTGGCAAGCA
686351 AGAAATTTTA TGTTTTACAT TTTTGAAAGC TTCTCAACAC CTACAGTAAT
686401 ATACTACTTA ATGGCTTATT TATTAATTGC TGATAATAAA ACCAATAGGA
686451 AATAAGTAGA AAGAAAGTGA TTGAAATTAT AAGAACATTG TCTTTAGTAC
686501 AATTACATTC ATTTCTTCTC TGATATCACT GTTAATCACA ACCCACCAAT
686551 CTGTAAACCT AAAACAATCT TCAATATATT GCAAAAGCAA TGAAAAATCT
686601 GCAATAGAAA GAAGCAAATG TAGCAAATGT TAAAGCACTT ACAATGATGG
686651 GTTAGGATAT TCACAAGCAG ACAAGAAAAT TCACAAGCAG AGGGGGAAAG
686701 TCTCTAAAAG CATATTGAAC ACAAAAGGAT ATCTATAGCC TGGATAAGAT
686751 CCAATAAAAA TGATTTATAA AATCACAGAA TACATAATAT TTTAATATTT

FIGURE 3TTTTTTTT

686801 ATAAATATCT GCAATACATC TAGTCCTTCT AACCTAAGTG CTAATCAGTG
686851 AGGAATAATC AAATGCCAGT CACAGTTCTC AAGATATTTT CCGTACAGTT
686901 TGATGATTAA GAATCTCATG AAATGCCAAG TGCTGTTTGT TCGTGTGTTA
686951 GCAACATTCA GCATTGTCTA ATTCAGAGAA ACTCTCCCTT TTCCCATGAT
687001 TTTAGAACAA ACCCAGACTA TATTGATTTA CTGAGAAAGA TCAATCAGCA
687051 CATGTCCAGC AAGCAGAGAG TAAAATGTCA TTGGCCCATC TTGCTTGTAC
687101 AGAAAAAAAG ACAAAGTAAA ACTATACACA AACATGCTGA CTTTATTTTT
687151 TTTGTAACTT TTTTTTTTAG GTTCAGAGGT TTATGTGCAG GTTTGTTGCA
687201 TGGGTAAATT GTGTGTCACT AGTGTCACTA AAGTTTGGTG TATAAATGAT
687251 CCCACCACCC AGGTAGTGAG CATAGAACCC AATAGGTAGT TTTCAACCCT
687301 AACCCCACCT CTGTCTAGTA GTCCCGAGTG TCTATTTTTC CTTTCTTTAT
687351 GTCAATGCAT ACTCCATGTT TTGCTCCCAC TTAAAATAAC ATACCTGCTG
687401 ACATTAAATC TAGAGTTTCA AAGATACCAA CAGAGGAAAT AAAGTCATAA
687451 CTAATGCTTA ATCGCTAGTT TCATCTCTGA TGTGAAAAGA ATGCTTTTGT
687501 CCTTCAACAG TAAACAGCTA AGAAGGAAAA CATGATAAAT ACCAGACAAA
687551 CCACATGAAA TCTTTATGGG AAAGCTTACT TATTCCCAGT GTAAAAAGCT
687601 TCACATCAAT GGCAAATAAA GTGAAAACAT TACCGGTTAT TTATGCTGTT
687651 TGCAACAGAC CCTATTGGCT GCCCATTCAA CCTCTCTTGT TATTTCTTCC
687701 TGGCTAATGA AACCTTGAAA TTTGGATGTT TTCAATGAGC TCAGATCCAA
687751 GAAATAAATC AGGATTTATA TGTCAGTTAT AGTTATACCA CTATCCTTGG
687801 ACACTTAAGT TTTACACTTA AATATAATAG AAGTGAGATG AGGAATTTAT
687851 TGGAAAATTT CTAGTTGAAA TCTATCAAAA ATAGGTTTGA GTGGGGAGCT
687901 TTCTAGTACT GGCCCTTTCA CTTTCTTTAT TGCTTTGAAT ATGGTTTTGG
687951 GAGGACATAA TGCTTGGAGC TGTGACAGCC CTCTTGCAGA CATGAGGCAG
688001 CAAGCCTAAG GAGTTAAACC CAATGCTGAG TATGGCCAAG TAGGAAGATC
688051 TAAAGAGCCT GGATCTCAGA TGAAATTGCT GAATTTCTGC ATCAAAACAG
688101 AAACTTACTC CTGTTTTTTA TTTCCTAATT TAATTAAGTG TTTTATTTGC
688151 TTAAGCATCT GAGTGTTGGG TATTATGACT CTATGACTTG TATCTGAAGA
688201 CATTCTACCT GATATAGTAA TCAACAAATA TGAAAACTTC CATATTAATA
688251 GATAACATAA ATAGAGAAAT AATAAAATGA GGAGTTTAAG TATTGTGTCC
688301 CCACAATCAC ACAAACTAAC TAGGTATAAG GATACTATAA ACATACAGTT
688351 AGTTTGGGGC CCCAATAATC ATACATTTTA CATATATTCT TAATATTATA
688401 AGTCACTATG TTAGGTAGTG GGGATAAAAG TGCTTAGGGT CTCAAAAGGA
688451 AAAATAGACA AGTATGATTG CATCAAACTA AAAAGCTTCT GAATAACAAA
688501 GGAAACAATC AACAAAATGA AAAACAACCT ACAGAATGAG AGAAAACACT
688551 TGCAAACCAT AGTTTTCTGA TAAGGAATTA ATATGCAAAA TATGTAAGGA
688601 ACTCATACAA CTCAATAATA ATAATAACCT GGTTAAACAT GGGCAAAAGA
688651 CCTGAATAGG TATTTCTCAG AAGAAGACAT ACAAATGGCC AACAGGTATA
688701 TGAAAAGGCA GTCAACATCA CTAATCGTCA TGGAAATGCA AATAAAAACG
688751 CAATAAGATA TCACCTCATA CCTATTAGAA TGGTGATTAT CAAAAAGACA
688801 AAAAATAGCA AGTGGTGGTG AAGATACAGG GAAAAGTGAA CTTTTGCACA
688851 TTGTGCATGG TAATGTAAAT TGGTACAGCT ATCATGGAAA ACAGTCTAGA
688901 AGTTCCTCAG AAAATTAACG ATAGAATTAC CATATGATTC AGCAATCCCA
688951 CTTCTAGGTA TATAATCAAA GGAAATGAAA TCAGTATCTT GAAGAGATTC
689001 TGCACTCCTG TGTGTGCTGC ATCATTATTC AAAATAGCCA AGATATAAAA
689051 ACAACCTAAA TATTTCTTTT TGAATGAATG GATAAAGAAA ATGTGGTGTG
689101 CGAATTATCA TTCAGCCCCC AAAAAGAAAA TCCTGCCATT TGCAAAACAT
689151 AGATGAACGT AGAGGACATT ATGCTAAATG ACATAATCCA GAATCAGAGA
689201 GACAAATACA ACATGATCTC ATTTACATGT AGAATCTAAA ATAGTCTCAT
689251 AGAAGCAGAG TAGAATGGTT GTTACCAAGA GCTGCAGGGA GAGGGAAATG
689301 GGAAGATGTT GGCCAAAGGG TACTAAGTTT TAGTTAGGAT GAATATTTCT
689351 GGAGAGCTAA TACACAATAC TAAATTTAAC AATACTATAT TGTATGCTAG
689401 AAATTTGTTA AAAGGGTAGA TCTTAAGTGT TCTCACCAGA AATTTTAAAA
689451 AAGAAAGGTA AATATGTGAG GTGATAAATA TGTTACCTAG CTTGATTGTG
689501 GTTATGATTT CACAATGTAT ATTAAAAACA TCAAATTTTA TACCTTATAT
689551 ATAGATAATT TTTTGTCAGT CATATTCAGT AAAGCTGAAA AAGCGCTGGG
689601 GAGAAAACAT TAAATAATCA TGCTATTGGA TAAGTAATTA CAATCTGAGA
689651 TTCTGTACAA CAAATCTGTG AGTACCTACT GTTTTGGTAG GTACTGTTCT
689701 GGTCACTGGA CATATTCCAA TAAGTAAGCT TTCTTCATAC AGTTTACAGT
689751 CTTGAGGATG GCAGAAATAA AAAATAATTT TTAAAAGATA ATCTCAGATA
689801 GTGATAAATA TTGGATATAC AACAAAAATA AAAGTGAGTA GCTACCTTGA
689851 AAGACATGGC CAGTAAATAT TTCTTTAATA AGGTTGTCAC CTTTGAAGTA
689901 AGACCTGAAA ATTGTAAAGG TACCAGCCAG GAAAAGATTT GAAGTCAGAA
689951 TCTTCAAAGA TGAGAAAAAA ACAAATATAG CTCCTAAGAT GAGAACAAGC
690001 TTGGTGTATT TTAAAACTAG TAATAAAGCC AGGATGGTTG ATACCCTGAG
690051 AGGTAGGGGA GAGTGTTAAG GAAACAAAGA AAGAAGAGCC AGATGCTGTA
690101 GGAACTCAAA GGGCATGGAA AAGAGTAGAA ATTATATTCT ATCTACAAAA
690151 GGAAGCCACT GGAAAATTTT AAGCAAAGGG TGACATATGA TTTGTGTTCT

FIGURE 3UUUUUUUU

690201 AAAGAGCTCA TTCTGGCTGT ATATTGAGAT TGATTTACAG AGAGGAGGGG
690251 AGAGAGATAG CAAAGAGATC CATTTGCACA ACCCTAGACA GGAAATGATG
690301 GTGCCTTAGT TTATGCCGGT AAAGAAGAAA ATGAAGAGTG GTGAAGATAT
690351 TTGGGATATC TTGTGGCAGT AGATCAGCTT GGAGAAAATA TATATATTAT
690401 ATGTTATATA TTATATATTA TATATTTTAT ATATATATAC ACATACATAT
690451 ATATGTTTTT TGTGTATGTT TTGGGGTTTT TTGTTTCTCT AGATGAGGAA
690501 ATTGAGGCCC AAAGAAATGA TTTACACAAG TCACACGGCT ATTCCATGGG
690551 AGACTATGTC AGTTAGCCAT TGCAATAACA ATGTTTGGGG AAAGTGCCTG
690601 TCCCACAATC AAATCCTCCT TCTTCCCCAG TAGTTTCCAC TGCAAATTCT
690651 TTTCTGTCAT ATGCAAACTC CCTTCAATCT CTTACCTCTG AGACTCTTGC
690701 AGAAGACAAT GGATATCGGC AGTTGAAAGT CTTTGAAGGT TGAGAAAAAA
690751 AGAGAAAGAT CTCATCATTT TTTATGGGTG CATAGTATTC CATGGTGTAT
690801 ATGTGCCACA TTTTCTTAAT CCAGTCTATC ATCGTTGGAC ATTTGGGTTG
690851 CTTCCAAGTC TTTGCTATTG TGAATAGTGC CGCAATAAAC ATACGTGTGC
690901 ATGTGTCTTT GTAGCAGCAT GATTTATAGT CCTTTGGGTA TATACCCAGT
690951 AATGGGATGG CTGGGTCAAA TGGTATTTCT AGTTCTAGAT CCCTGAGAAA
691001 TTGAACAATG AGAACACATG GACACAGGAA GTGGAACATC ACACACTGGG
691051 GGGCCTGTTG TGGATGGGGG GAGGGGGGAG GGATAGCATA GGAGATATAC
691101 CTAATGTTAA ATGACGAGTT AATGGGTGCA GCACACCAAC ATGGCACATG
691151 TATACATATG TAACAAACCT GCACGTTGTG CACATGTACC CTAAAACTTA
691201 AAGTATAATA AAAAAAGAAG AGAAAGATCT CTTAGTCTTT GGCGATAGAT
691251 GTTACAAATG CAAACACACC TCAAAATGTT TTTTTTTTAT TTTTCTTACC
691301 AGTCTTTTCA AATTATTCTA CAGTGAGTAT TGTACTTTTA TGGTAAACGA
691351 AAGTATTCTA CAGTGAGTAT TGTACTTTTA TGGTAAAGGA AAGAGAACAA
691401 TATATGTTAT AAAACTATAG AAAGAAATAG CTCCTGGCAG AGTTCCAAGG
691451 TAGCCTTCTG TTTGGTATAT TAAAATTTCT TCTCTCTGGT ATTAGTTGCT
691501 AAACAACATG TTTGTTTTAA TGCTACTTCT TTAATCAAAA AGTTGGCTGG
691551 AGGTCACTTC ACTAGGCAAC ATTTATTTTT AAATGAAAGA TAAAGAGATT
691601 AAGGAAATAA ATATTACTAC TACTGATTTT TTAAATGGAA TTCTGGTCAA
691651 TATTCCAAGA AACTTCAGAT TCTTCCCCAG AGTTTAAAAT CTAATACCTA
691701 TTCCTCAGTG TCACCATAGG GCCTACCATA AGCCCCAGAA TCAACTTTTC
691751 CGAACCTATA AATAATGATT AGGAGATCTG AAGCTAGAGA AAATGCTACA
691801 GAATCTTAAA GTGTGTGTTT AAAGATAAAA AATTTTAAAT ATTATAAAAA
691851 TGTATCCATA TCCTTATTAA GAAATAAATA CCTTTTTTTC TTTTTCATTT
691901 ACTGTATTTT CCTACCTGGC TATCCATTGA TTGGTCTGTG CTAGCTACTT
691951 ACTGATCAGG CTTATATAGG TCAAACCTTT GCAGTCATGA TTTATTGCAG
692001 GAAAGCAAAA GAAAGCACTG AAAAAATGAC TGCAAAGAGC TTTCCTCAAA
692051 CTCTCCCTTG GGCCTCTCTG TCTCTTCAAG TAACAGCTCT GAATGCATCT
692101 ATGATCCATC AATATTTTCA TATATTCATA TCATTCCCTG TTCACATTAA
692151 CATAAACACA CAAAGTTTCA CTGTACCTAG TTTTGCTTCT TTAAACTTGC
692201 AATAAGAACA GGGTATTATC ATATGAAACA TACACATTAC TCAGTTGTTT
692251 AACCATCCTC TTAATCAGTG TATAATATGT GTCACAAAAA GGCAGCTGCT
692301 AAATGAATTA TACATAAAGG TAATGCTTTC TAGATTACTC CTGCCTGTAT
692351 ATATTGCATA ATTTAGGCCT GGTCCTTAAT TTTCTTTTTA TGGAAGCTGA
692401 ATCATTACCT TGTTCTTTTA GTAGTCCAAA TGTTTGTTTT TCCTGTATGC
692451 TATAAAAGTA AACTTTTTAA GAGAAGTCAA CATTTTAAAT TTGTGTTTAT
692501 AGCATGTATT TTTCTAAAGG CTCTTTTTTT AAGGAAAATT TTCAGGCTGT
692551 GTTTCTTAGT TAAGATGAAA CTATGTTTAC TTTTAAAAAT AACTGCCACT
692601 AAAGGAAAAG CATAAATTTG ATAGAACCAA GTTGTTTTCT TATATAAAGT
692651 AAAAACTAAC AAAGAAGTCA AGGAATAAAC TATTATACCT TCATCTCCAC
692701 CCTACCCTCT ATAGGTTCCA TAATCAAGGC ATTTCAGTAG CCCAATATGG
692751 ATATGGAGTC ATTAAGAAAT GGAAATACTA CAGACATAAT ATGGTAGAGT
692801 AAACAGTAGG TTATAAACTT GGAGCTGTGA TTTTAATCTC AGCTTGGCCA
692851 TAATTCAGTG AACAGACACG AATCATTAAT TTGAAATCCT TGTACCTCGG
692901 TTTCCACATC TTGAACAGAA TTAATAAAAC TGACCACTCT ATTTTACAGA
692951 ATGTTATAAG AACGAACAGG ATAATAAATA AGCTAAATTA TAGATCCTAG
693001 CCACTATTGA GACTAACAGC CTAGGAGTCA CCAGAGACAC TTATTGAAAA
693051 ATGCAGATTT CCAGTTTCAG CCCCTGAAAT TCATTTTTAT TCAGTATGTC
693101 TGAGGGAAGA ATAGCAAGAA TTTCCAATCT GGAAATTCAG ATTTTTAATA
693151 AACACCCAGG TGATTGTGAA ACAGGTTATC TAAGAGTTCC ATCTTGATTA
693201 ACTGCCCTAC TACAATCTAG ACACATATCC AATTATTTCC TCCTCCAGCC
693251 TTACACATCA TTAGATAGGA CAGAAGTCAC AAGCAGGTAA AAGAATTGTC
693301 AATACAGTGG AAAGGGGGAG GAAATAGGAA GGAAAAGGAG TGAATAATGG
693351 GAAATTAGAG CTGTTCTGGT TACACTAAGC ATACTGTACA ACATAAATTA
693401 ATAATTTCCC TGGCATTATT CTTAGCATTA TGCTTTTCTA TCTCACCCAC
693451 ACACTTTTAG TTTCTATTAT AAGATAGTTT TTCATGTAAA ACATGCTTTA
693501 TAATGAAGAG TGAGACTATG AGCCCTGATT TTTTTCTCTG GTGCTCCTTT
693551 TGTTGAATTT AGTATTTTCC CTTTTGCTAC CTTTTTCTTG CATTTTCTTC

FIGURE 3VVVVVVVV

693601 TCTTTAATGT ATCCATGACA ATTATTTGTC TCCAATATAG ACCAATGTAA
693651 AAATGTATGT CCCTTCCATG GCACTTACTG AAGACCTTAA AATTTTGTGA
693701 AAATACTTTA AACTATGATA TAACTATAAC CTATGGCCAG AACATAGACA
693751 ACTTTTCTTA GACAGTAATG TCATTCAGTT GCCTCAGGTG CTTAATTTTA
693801 TCTCAGAGTC TTAAAACAAT TACATATTAT TTCAGATTAT GCCATGAAAC
693851 TTTAATATCT CTAAAGTCAA TGGGGTTTTA AGGCACTTGG AAACGATTAG
693901 GTTTTGCTTG AACTCCAATA TACCTTACGG GAAATAGAAG AAACCGTGGG
693951 AATTGCAGTT TCAAGAGTTT TGACCTAGAA TATCCCCCTT GTTCGAAGGT
694001 GAAATTCATA TTCCACATTC AACATTAGAA ACTACAGTAA TCTCCAGATC
694051 ACTTTATTAA AACTGCACAT GCTGAGGGGG AAAAAGACAT AAAAGCATGA
694101 TAAAACAACA CCTTTGTAAA AGCATCAAAC CATGCTACCA AAGGGTCATG
694151 ATACATTTGT ATAGGTGTGC CCTCTTGTGG TGAATGAATG GAACCCAGGA
694201 CATTTGGAAA GCGTTCTGAA AATCAGGGAA GAGCAATTTT GATTTTTGTT
694251 TTTCTTTCTT AGTTTAATAT TGCCTGAGAT AGAAAATGTA CATATTAATA
694301 AGCCATGATA AAAAAGGATT TTACTTAGTA TGTATATTTA TTAAAGCTTA
694351 ATAACTCTGA ACTATTTACC CAGAGAGGAA GGAGCAAATG AAATTGTCTG
694401 CTAGTATTTA ACTGCGAAGT TTCCCAGACT TAAATTGGGA TTCCCATAGT
694451 GGACTTTAAT CTGATTTAGT CAGTGTTTCC ATCTATAAAA TTTAAGATAT
694501 AATTAGAAAC AAAATCCCAG TAAAAAGATC AAATGTAAAA TTAGAAAAAG
694551 GAATTATTAA AGTGAAAAAG TTTGTGTTTA GAACAAATCA GGTAGAAGAA
694601 AGAAAGGAGT AGAGAGAAAC TTACATGGAA AAGAGAATAA AACATGCAGG
694651 CTTTTCGGTG ACATTTTTAA ATGCCAATGC TAAGTTATCT TGCATATGAA
694701 TGAAATTTAT GCTTTTGAGA ACATTGAAGA GATGATGAAA ATGTCCCACA
694751 GGGCAAGAGG GCAACTATGA TTTCAGAGCA AGGTGTGAGG CAGTGAGAGT
694801 TTCTACATAT TGGTTCAGTA GCTTGTATCA AATGTCCTAT ACTTCATAAT
694851 CTAATTGATA CACATGGGGG AAAAAACAGA GAGATACAAA CCCAACAACC
694901 TGATTGAACT CTAATTAAGG AAGAGAAAAA CAGTAAAAGG TTAAACCTGA
694951 AGAGAATATT GAAATATAAC GTAACACAGT AATTTTCTTT TGTATTGGGA
695001 AAGTTACCAG AGGTCATAAT AGCAATTGCA GGCACTACTT TGAAAAATAA
695051 GTGGTACTTA TTATGCTTAT ATATTAATGA ATTTTGAATA AAATGATTAT
695101 AAATTATTTT CCTGCACTAC CACAGATTAT GCTTTAATAT ATATCATCAC
695151 AGAGTTTAGA ACACATTTGT TCAAGTAAGA GCCTCCCATT CTATCACCAC
695201 CATTACAGTT TATTTAAGTA CTAGAAATGG CACAGAAAGA TATAAGGCAT
695251 TTTAGCACCT AGTAGTATCA TACAGGAAAC TATTCGTAGA TGGGTATTGT
695301 TCTTATTCTG AAATAGAGAA ATATAAGGAA ATCTCAAGAA CAGAACATTA
695351 CCTTTTCTGT GATCGTTTAA ATTCTGTTTC TGGCTACATA TTCTTATGTG
695401 CATTTTTTTA ATTTTTACTC TTGAAACCCT ATAAAACATT GACAGAAAGA
695451 GGATTGTAAC AACCATATAT AATAGCATTC ATTATGCTCC CTTCAGTATT
695501 TTGCACTGTT CTCTTGATTT TTTAATATCA CTGTATATTC ATTTTCACTA
695551 GCTATCTAAC TTTCAATTTG TGAGATTAAT CTAGGTCACA TTTTCATCAA
695601 TATAGTTTCT AATGAAAGTT TTTAAAAACT CATCATGTCT TGCTACTCCC
695651 TAGATTGTAG CCATCCTGCC ATTCACATTG GAAAGAAATG AAGTGCAGAG
695701 GAATCTAAAC TGTGTAATTT GAAAGGTGTT GAGACCAGAT TGCAAAGTTC
695751 CTGTCCCTCA GTGTATGTAG CTTGAATTTA GCTTGCCTGG AACAATCCAA
695801 GATAAAAGAG AGGATAAGTG AGGCGGGGCA CAATTTACAA GAGACAAACA
695851 AGAATGGAAT ACAAATGTGG CACATTCTGA CAGAAATATG CCTCATTAAA
695901 ACATCATTCT GTGAGCTCGC TTGATTTGCC TGTATTGTGC CCAGAATCTC
695951 AGCTGCCATA GCCAGAGAGG GCCCACCAGT ACAGACATTG ACAGGTGACA
696001 ATATCTGGAG AGTATTCTTT AATTCTGGAT TCATTGTGAT GACAAAGGGA
696051 TTACTTAAAA TAGCCTAAAC CTATGTTATG AAAATAAAAT GAAATAACAT
696101 TTTGCCATGT ATTAAATTAA CCATAGGCCT ACTCAACATA CAAAAAAAAT
696151 GACATCCTAA TATTAAATCC CTATTTCTTC TAATTAAAAT TAGTAAAATG
696201 TATCTAAGAC AGTAGTCTTG TTTTGTTCTA ATCTGAATTC TTCCAGTTTT
696251 CAATGTCTCT TTTCTGTAGT TTGTCATTTT TATCAATACA TTTGCTCAAA
696301 GTACACTTCA GTTACAGTAT TTTCCACTGA ATTTCTAAGG TGAAATTTCT
696351 AAGGTGAATT ACTTCCTATA ATAAAGTGGA AAATATTAGT TCCCTGCTCT
696401 TTTTGTAAAT CCAGAAATAA CATCTCTTTG TGTGGTGCTG TAGCACCTCC
696451 AGTATCTTTC TGAGTCCTCA TATTATACAC TGCACTTTTC ATATAAATGG
696501 AAAATATTGA GAAGGATTTT TGGTATTACA TTATCAAGAC AATTTCAGAG
696551 TGAAAAGAAT TGTAGCTAAG ATTGTACTCC CTAACGCTGG TCAGCTTACT
696601 TGGAGTTGTC TCAAGTCCCT GTGTTTATCT TAAGAAAGAA ATTAATGTAG
696651 TTCAACAGCC CCTCTACTAG CTTTGAACAC TGCAGAAATC TTATAGAACA
696701 TTAGCGTTTA TGTGGGTGGG GCCCTATTAC TGAGACATCT TATAATTCAT
696751 AAAACATCAT GGTTCTCAAG ATGCAAATTC TTCTATTTTT AAGTAAAATA
696801 ATCAGGTTTT GCAGACATTC AGACTAAAAA TCCCAGTAGA AATTACATTA
696851 ACCTAGGCAA CTTTTTAAGA ACACAAAACT GGGAGAATTG TAAAATTCTG
696901 CCTTGAAGTG AAACCAGTTT CTACTTTCAA TGGTAATTAT TGAATCTTAG
696951 CTGGTTATTC TTAAACCAGA TCATTAAAAG GAAAATCCTA CTTGAGTGAA

FIGURE 3WWWWWWWWW

697001 GGAATCCTGA TATTAAAGTT GTAGTGAGGT TTATTTTCAT TTCAGTGGTC
697051 CTCCTTAAGC ATTCCTTCCC AGTCAGAACT TTCTGAATAT CTCTTTGGTG
697101 CTTACACAAA TGTATACAAG CTTGAGGGTT ATATCTTTGA ATTTCCTCTT
697151 ATGGATGTCC TGGTAGTCCT TGTATACAAA GTGCATGATT GGCATATACA
697201 AAATCTGCAC AGCTCTGAGA CTGCTGCTCA GCAAATTTGC AAAAAGTGCT
697251 TCACTGTCTT GGTGAAAAAG TATCCCTCTT CCCCCAGTAT ATACTGAAAT
697301 GTCAAAAGCA TTGTTTATGT ATGATTTTGG CCACCAACTA TCTGATAGGG
697351 CTTCCTTATA GGTCCTAGTG ACCCTTTGTA GCTCAAATAA GAGATTGAGG
697401 TCTTTTTAGC AGTATGTCAA AACTAACAGC TGAGGGAAAA AAGAGAAAAG
697451 AGAAAAGGTG GAAGAGGAAG GAGGAATAAA TACTAAGCCT CCTTTGCTTT
697501 AGGCTTAGGT AATCAGCCTG TCCCTTTATG TGAATATCTC CTGATTCCCA
697551 CTTTTAAAAT TTTTAGTAAA TGTTAATTTA ACATGTGAAA AAGACAATGA
697601 AGATGAAACA CGTTTTAAAA CAATATGCAG AATAACTAAG GATTAAGCAA
697651 GGTATAAACT GGAAGATTAA AAAGGGCTTG GAGGTGCCCT AAGAAAGGGA
697701 TTCTTCTTTA GTGAAAATAT CGTAGGCCCA GTCACAGACC CTGTCCCATA
697751 CTGCAGTAAG GACCTCTCAC CTGCAGCGTT CAGACTGAAG GCGACAAAAC
697801 AAGCCACCCT CTGAGAGAAT GCATCCCAGT TCATCTCCCA GCTCAATTCA
697851 TCTCTGACAA TCCAGAATAA ATATTCTCCG CTCCTCCTTC AGCTAATTTC
697901 CCTTAGAGAA GAATTTTGTG GGAGACTTGA ACTATTTCTT TAATCACAAA
697951 ATAAAATAAT CTTTAGGGAA TATTTAAAGA TGCCTATTTT TATGGCATAC
698001 CCCTAGCATC TACTGTTAAC AAGTGGAACA AATATTTACT TGAACTAAAT
698051 ATCCACCAAC AAAAAAACAG ATAAATAAAG TACGCTGTAT CCAAGTGACG
698101 AGCTATGTAG CAGGCACTGG CAGTATGCTG CCTGGGGCTT TTCATATCTC
698151 TTTACCATTT CTGTGTACAC AGGCTTCCAA TATGCATGTA CTGCAACAGT
698201 CAGCACTCAG GGCCTTGTCG AGGCCACCCT AAAGCCTGCT GGAACTCACT
698251 TTCCCTGCAG GCAACAAGAT CTGGGAAGCA ACTTGGAATT TACATCCCAC
698301 CAGGGTCAGT CTTTGATCAA TGACTACTAA GGATATGAGG TACAAAGGCT
698351 TTAGCCCTCT TGCCTCTGAA CAACTCTGAG GGGAAATGCA AAAAGAAATA
698401 CATGAGAATG ACAAAGACTA AGTTCAGTGT AGGAAGTATC ATGGGGTAGG
698451 ACAAAGGGGA AGGAAAGAGA TCTGGAGAAG GAACCCCTGG GGCTTCAGCT
698501 ATATTAGAAA TATATATTTT TAAAGCCAAG AGTTGGAGAC ATAGTTAGCA
698551 TCAGATTGGT GTTTATGTGA CTTTTGTGTG TTTGAAATAG TTTATAATAT
698601 TTTATTTTTT GTGGAGCCTT TTTTTTTCTT TTTTTATATA TACTTTTTTT
698651 ATTATACTTT AAGTTTTAGG GTACATGTGC ACAACGTGCA GGTTTGTTAC
698701 ATATGTATAC ATGTGCCATG TTGGTGTGCT GCACCCATTA ACTCGTCATT
698751 TACATTAGGC ATATCTCCTA ATGCTATCGC TCCCCCCTCC CCCCACCCCA
698801 CAACAGGCCC CGGTGTATGA TGTTCCCCTT CCTCTATCCA AGTGTTCTCA
698851 TTGTTCAATT GCCTGCCTAT GAGTAAGAAC ATGTGGTGTT TGGTTTTTTG
698901 TCCTTGCAGT AGTTTGCTGA GAATGATGGT TTCCAGCTTC ATCCATGTCC
698951 CTACAAAGGA CATGAACTCA TCATTTTTTA TGGCTGCATA GTATTCCATG
699001 GTGTATATGT GCCACATTTT CTTAATCCAG TCTATCATTG CTGGACATTT
699051 GGGTTGGTTC CAAGTCTTTG CTATTGTGAA TAGTGTCACA ATAAATATAC
699101 GTGTGTATGT GTCTTTATAG CAGCATGATT TATAATCCTT TTGGTATATC
699151 CCCAGTAATG GGATGGCTGG GTCAAATGGT ATTTCTAGTT CTAGATCCCC
699201 GAGGAATTGC CACACCGTCT TCCACAATGG TTGAACTAGT TTACAGTCCC
699251 AGCAACAGTG TAAAAGTGTT CCTATTTCTC CACATCCTCT CCAGCACCTG
699301 TTGTTTCCTG ACTTTTTAAT GATCACCATT CTAACTGGTG TGAGATGGTG
699351 TCTCATTGTG GTTTTGATTT GCATTTCTCT GATGACCAGT GATGATGAGC
699401 ATTTTTTCAT GTGTGTTTTG GCTGCATAAA TGTCTTCTTT TGAGAAGTGT
699451 CTGTTCATAT CCTTTGCCCA CTTTTTGATG GGGTTGTTTG TTTTTTTCTT
699501 GTAAATTTGT TTGAGTTCTT TGTAGATTCT GGCTATTAGC CCTTTGTCAG
699551 ATGAGTAGAT GGCAAAAATT TTCTCCCATT CTGTAGGATG CCTGTTCACT
699601 CTGATGGTAG TTTCTTTTGC TGTGCAGAAG CTCTTTAGTT TAATTAGATC
699651 CCATTTGTCA GTTTTGGCTT TTGTTGCCAT TGAAACTGGA AGCATTCCCT
699701 TTGAAAACTG GTACAAGACA GGGATGCCCT CCCTCACCAC TCCTATTCAA
699751 CATAGTGTTG GAAGTTCTGG CCAGGGCAAT CAGGCAGGAG AAAGAAATAA
699801 AGGGTATTCA ATTAGGAAAA GAGGAAGTCA GATTGTCCCT GTTTGCAGAT
699851 GACATGATTG TATATCTAGA AAACCCCATT GTCTCAGCCC AAAATCTCCT
699901 TAAGCTGATA AGCAACTTGA GCAAATTCTC AGGATACAAA ATCAATGTGC
699951 ATAAATCACA ATCATTCTTA TACACCAATA ACAGATAAAC AAAGAGCCAA
700001 ATCATGAGTG AACTCCCATT CACAATTGCT TCAAAGAGAA TAAAATACCT
700051 AGGAATCCAA CTTACAAGGG ATGTGAAGGA CCTCTTCAAG GAGAACTACA
700101 AACCACTGCT CAACGAAATA AAAGAGGATA CAAACAAAAA GAACATTCCA
700151 TGCTGATGGA TAGGAAGAAT CAATATCGTG AACATGGCCA TACTGCCCAA
700201 GGTAATTTAT AGATTCAATG CCAACCCCAT CAAGCTACCA ATGACTTTCT
700251 TCACATAATT GGAAAAAACT AATTTAAAGT TCATATGGAA CCAAAAAAGA
700301 GCCTGCATTG CCAAGTCAAT CCTAAGTCAA AAGAACAAAG CTGGAGGCAT
700351 TATGCTACCT GACTTCAAAC TCTACTACAA GGCTACAGTA ACCAAAACAG

FIGURE 3XXXXXXXX

700401 CATGGTACTG GTACCAAAAC AGAGATACAG ACCAATGGAA CAGAACAGAG
700451 CCCTCAGAAA TAATACCACA CATCTACAAC TATCTGATCT TTGACAAACC
700501 TGACAAAAAC AAGAAATGGG GAAAGGATTC CCTATTTAAC AAATGGTGCT
700551 GGGAAAACTG GCTAGCCATA CGTAGAAAGC TGAAACTGGA TCCCTTCCTT
700601 GCACCTTATA CAAAAAAGTA ATTCAAGATG GATTAAAGAC TTAAATGTTA
700651 GACCTAAAAC CATAAAAACC CTAGAAGAAA ACCTAGGCAA TACCATTCAG
700701 GACATAGGCC TGGGCAAGGA CTTCATGTCA AAATAGTTTA TATTTTTTAA
700751 AATAAATATT TAGAAAGATT GATAAGGCAA CAACAACATG CTTGTCACTA
700801 AAAGTTCAGA CATGTTATCA GCATATTAAA AATGTTAAAA AAAAGATCCA
700851 GCCTGGTCAC AATTCTTCTT TATAGAAGGG TCATGTATCC AAATTTAGAG
700901 CCAAAAGAAG AGAAGCCCTT AAAACACAAT TCCATAACTA CCAATTATTC
700951 CACTTCTCCC ACGGACCTCA CTTTTCCTGG TTTTTATCTA ACTCATCAAT
701001 ACACACATCT TCCACATGTC TTTCTTCACC TGTCTTCCCA GCCTGGGTCA
701051 CATGGTCCAC CATTTAAAGA ATACACATTG GCCAGGCGCG GTGGGTCACG
701101 CCTGTAATCC CGGCACTTTG GGAGGCCAAG GCGGGCAGAT CACGAGATCA
701151 GGGGTTCGAC ACCAATCTGG CCAACATAGT GAAACCCCAT CTCTAAGAAA
701201 AACACAAAAA ATTAGCCAGG TGTGAGAGTG TGTGCCTGTA ATCCCAGCTA
701251 CTCAGGAGGC TGAGGCAGCA GAATCACTTG AACCAGGGAG GCGGAGGTTG
701301 CAGTGAGCTG AGATATCGCC GTTACACTCC AGCTGGGGAG ACAGTGTGAG
701351 ACTCCATCTC AAAAAAAAAA AAAAAAGAAT ACACATGAAT GCCTTGAATC
701401 ATCTGACGCC TTGCCTTGAA TTTTGTCCAA ATTCAGCCCT AGATAACACA
701451 TTTTCCCCCC TTGTTTCCGA TTCTGTTTCC AGCCTCCTGA ATGTTGCTGT
701501 TTATGTAGCA AAACTCTATG AATTTGAATT ATCTACAAAC TTGTACAATA
701551 GGATTACTGT TTGTAAGCAC TTTGAGGAGA GAGATTGTGC TTTTATTGTT
701601 ATTTCTATCA CTGTGTTAGT TTGCTAAGGC TGCCATAACA AAGCAGCACA
701651 AACTGAGTGG CTTAATCAAC AGAATTTATT GTCTCAAAGT TTTAGGGCTA
701701 GAAGTCTGAG ATCAAGGCCT CTACAGGCTT GGTTTCTTCT GAAAGTTGTG
701751 AAAGATAATC TGTTTTCTGT CTCTCTCCTA GTTTCTGGTG GTTTGTTGGC
701801 AATCCTTGAT GTTCCTTGGC TAGTAGAAGC ATCACCTCTA TCTCTGCCTT
701851 TATGTGTGTG TGCTTTTATA TGGCATTCTC CTGTGTGCAT GTCTCTTTGT
701901 CCAAATTTTC CCATTTCATA AGGACACCAG GGATATTGGA TTAGAAGCCC
701951 ACCCTACTTC AGTATGACCT CATTTTAGCA AATTACTTCT ACAATGACCC
702001 TATTTCTAAA TCAAATCATA TTTGGAGGCA CTAAGAGTTA AGGACTTTAA
702051 CATAAGAATT TGAGAGGACA AAATTCAATC CATAACAACC CCCTATGTCT
702101 GAGATCAGAA CCAATGAGAG GTTGTCTTTC CTTGATCTAA ACACAGCCCT
702151 CTGGAGAAGA GGCTTTAGTT TTTTAATTCA ATAAATATTT CTTCTTCAGC
702201 TCAACTGAAG AACTGTCATT TCTCTTTGGA CTTGAGCCCT GTATTTCCAT
702251 TAGTGTACTG TTGTCATATG CCCTATTCTA AGTAGTTTGT GTTTTAAGTA
702301 CTTTCTCATC TACCTCTTTT TATTAAACTG GAGAGCATTA TTTTCTACAT
702351 AATGTAGCCT TGGGACACCA CCATATTAGT TTCCCTAATG GGTTCTTTTG
702401 ACTTACAAAT GCCAGGTTTA TTTTGGCTTA CATATGAAGT TTGATTGCAT
702451 GCATTCATAA TTGAGTTTCC CTTGTGGTTT ATTAATCAGA ACCATCATAT
702501 CTCAAGATGA TAATTAGCTG GCAAGTTATA GCAAACATAT ACAAATTTAT
702551 TTATAGATAT CTCCCACTTT CTCTCTGCAT ATTAACATTG TCTAATAAAT
702601 CATATAACTG TAAAAGTGAC TGAATACCCA GATTAAATCT GTTACTTTTG
702651 TTGAAAATGT GACATTATAG AATAAGATTC TTAAACATTT ACAGTGTCTA
702701 TGGTTTTAAT TAATCTGATG CTCTATAATT TGATTCTTTA ATATTTTGAA
702751 ATGACTTCAC AGATATTTTT ACCATTCAGC ATGGAAGGGT GTTTGGTTCC
702801 ACATTAGGAA TTTATGTTAT ACAATATCAC CTCAGGAAAG ATGTTGCTAA
702851 AAAGACATAG ACACATTTCC ATTTTTCCAT TTACAATTTA ATTTAAACTG
702901 TAGAAAAATA AATTATCATA CAATACATTT GAACATCTTT ATATCTAAGT
702951 GCCTTTATGT AAATAAGAAA AAGTATACTT TGTAGAGAAC AACATGGGCA
703001 AACTCTTAAA TAACCTGGAA ACCATGGCCC ATTGGAAAGT GCAGCAGACC
703051 AGTGCCTGAC AGATCAAAAT TCTATCCCCA TTTCTCATAT TTGCTCTTTT
703101 TCATGGAGCA AATTAGACTA GTGAGTTACC CAGCAGAAGC ATCCTGCCTT
703151 TGGATGCTAC TTTGGAAGCT ATTTCTGTTC AAGTCTGTGT TGACTCGCTC
703201 GTAACTTCTT GGAACTAAAA GAGCAAGACA GTAAATACCC TTGCCTTACA
703251 GAGAGAGCGC TAAATAAACT ATAAATTCCT TTGTTAATTT TTCTCACAAG
703301 AGAAAGATCA CCAAGAGAAT GGTCACCAAA TTTCTCCCTC AATTTGTGTT
703351 ATTTTATATT TTTTTGCATT TGCTTTTGGA ATTGGTCTAT GACAACTCAC
703401 AAAACGTCTT TGTGGTAGGT AACTATAGCC ATCAAAATGC TTGAGATGGC
703451 TGAGAGTTAC CAACTGCCCT CATAATCTTG CTTCAAAGTA TAATGAGAGC
703501 AAATCAGACC TATTCTGCCT CATATGTCAA CATGTATTAA ATGAATATTA
703551 ACAAACAAGT ACAAAACCTT CATATAATTT GTTCAATAAA ATCTATGACT
703601 CCCAGATTTT TTTATAGGGG ATCCTCAAAC ATCTTGCCTG AAAAAGCGTC
703651 AAAGAAGCCA AAACAACATC CCAGTGCCAA GATTCTGTAG ACTTATTGTC
703701 CAAGATGTCA GAAATCCTCA GATTCACTGC TTGAACCGTT GGTTATTATT
703751 TGGGGATCAG GATCCCTCCT TCAGATGACC AGCTAACCAT AGGCTTTTCT

FIGURE 3YYYYYYYY

703801 GGATTTCTCT AACCTGATTA TGCAAGAGGA AGAAGTATCT CTGAAATATT
703851 TTAGCCAGTT GTCTTGAATA CCACTAATTC CACCAATGAA GGCCCACTTC
703901 TAATACCCAT TATGCTGATT AAGTATCCAC TAATTGGCTG GGCCTTATGG
703951 CTAACACCTG TAATCCCAGC ACTTTGGGAG GCCGAGGTGG GCAGATCACT
704001 TGAGGTCAGG AGTTTGAGAC CAGCCTGGGC AACATGGCAA AAACCTGTCT
704051 CTACTAAAAA TACAAAAATT AGCTGGGCAT GGTGGAGAGT GCCTGTAGTC
704101 CCAGCTCTCG GGAGGCTGAG GCAGGAGAGT CGCTTGAACC TGGGAGGTAA
704151 AGGTTGCAGT GAGCCAGATG GTGCCACTGC ACTCCAGCCT GTGTGACAGA
704201 GTGAGACTCT GTCTCAAAAA AAAAAAAAAA AAAAAAAAAA AAAAAAAAAT
704251 CCACTAAGTC AGCCAATGAA AATCCTTTTC TAACATTCTG ACATTCATTA
704301 TGCTAATTAT TAAAGCTTCT GGTATTGATC CAGTATAAAT AGCCAACTCA
704351 GTTGTATCAG TCCCTTCTAA GGTCTGGGCT TCCTTTTAGA ATGTTAGTGA
704401 GTCATCCCTG AGTTGCGAGA TCCCAAAGGT ACACTAACTG TAGGCTCTGA
704451 AGTAACTTTC AGTAAATTAC AGGCATCATA GCATTGTAGC AAGTCTCTAA
704501 AATACTAAGA TCTTTCATAT GTGTCCATTA TTCTATTGTT GACCTCCTCT
704551 TTTACTTTCT GTTTTGTTTT TTTTTTCTAA TATATATACC CATGTTATCC
704601 TTTATGTTAC CTTGCATTCT CGTTTGGCTT CTCTTTTTTC ATTGTGTAGA
704651 TCAGTGTATC AGTAATTATC TTGCATCTCC CAGGAAATAA GCTTTTTTGT
704701 CATGATCTAG AATCATATTT TCTCCAAGAG TAGTCTCTAG ACCACCTGTT
704751 TAGAAAAAAT CCAGGGTACA TTTTTAAAAA TGCAGACCAT GGCCAGGCAC
704801 AGTGGCACTC ACCTAGAGTC CTAGCTTAGG CTGAGAGAGG AGGATTGCTT
704851 GAGCTCAGGA GTTCAGGTCC AGCCTGGGCA ACATAGTGAT ATCCCATCTT
704901 AAAAAAAAAA AAAAAAGAAG AAGTAGACTT CTGAGGTTGA TCTAGAAATC
704951 TGCAATTTTT AACAGACACC CCCCACTCCA TGATTTTTAT ACACATTTAA
705001 GTTTGAAACC AAATTATATT TTGCTTGTTC CAGTCTAGTA GTAAGAACCC
705051 TATTAAACAT AAATTGTTCA GGTTAGTTGT ATTTAGTATT TTTACTTGTT
705101 ACATCTACTT TTCAGCACAT TGTGGAACCT TCATAAATAT TCAGCAACTG
705151 TAAAGGAAAC TCTCAATTAT TCAGGTGTGA ATTAACAGCT GATGGATAAT
705201 CCAGGCCCTC AGCCTCTTCT GCCTTTTCCT TAATGCATTT GCCTATTTCT
705251 CTGGAGGACA AATCACTCAT CTTTTGCAAC CTATTAGCAA GTTTGATGAA
705301 AGGCCCAGAT CAGATTCTAG GCATATTAAA ATGTGGTTGG AGGATTTTCT
705351 CTTCAATAAA TACCCCACCT AAAAAAATTA TTTCTTCTAT AGATAATGAA
705401 GACTTAGCTA TAATATCCAC CAACCAAACA AGGGCAGAAA AGACTGACCT
705451 GACCCATTTG CTGGGAAATA AAAGACCTCA AAGTTAGCTT TTTAAGTTAC
705501 AAGGCATGTT TCTAAATGTC CACATAAAAC ACCATAAATA CAGCTAGATT
705551 ATGGAGTGAT TAAATACAGG ATAAAAAATG GCTTCCCACA AGAGTTTGAA
705601 AATAGCATTG ACTGGTATCC GTAGTCAAAA TTGGGAAGAA ATTTGACAAA
705651 AATAGACAAA AGCAACCCTT TCTTCTCAGT TGTAGAAAAT ATAATATTTG
705701 CCCGTCTCTA GTACTCAGGT CAAAAAAGAC TTTGCCACTT TTTTTCTTTT
705751 ATGTCTTCTG ACATCTTTCT TTCCATAGAG TTTTCTCAGG TCTCCTAGGA
705801 TATTATTGCC AAACCCAGGC TAACCTGTTG AATTTATGCA ATAGAACTAA
705851 TGTTTTAGGA CTATTCTTAC TCAGTGGAAG ACTCTTGTAT AGCTGCAGCT
705901 GTCTGGTTGT GCAACACATA GGGCCCAGAT CACTCACTGT CAAGTAATTA
705951 GGGACAAAGC ATGGGATTCA TAATGCCTTC AAACAGAAAC AAAAATCTGA
706001 TTTGAAAGAT GTCTGATATT TTAATGAATT TTCTGCAGGC AGCATAGCAC
706051 TCCACTCTAG TTTGTTCACT ATCCATATAG GTCCTTTGTA AATCACCGTC
706101 ATCACACACA CTTCTATTTA TATTTCTTTC TTTGAAACAG ATATTGTGTT
706151 AGCTTCTCTA ATTTTTCCAC TAGACTGCTG CTATTATCTG TACAGGACAC
706201 CAAGGCCTTC CACAAAGGAG AATTTCACTC ATCGGATCTA GGAGCTGTGG
706251 AATGGCTAAG GACCTCCACG AACAATCATA TTTAAAATAT CATAGAGGAT
706301 CTTCTAGAGA ATCTAGATTA GCTTCTGTCA GGATCCTTGG TGGCTCCTAT
706351 GTGGTGTCAA GTCAGTCACT GACCACACGT ATTTTAGTGT ATCTCCTAGA
706401 GTCTCGGTTA TCCCTTCTGT AAAAATGTAA CTGTACCCTT CATCTCACTG
706451 ATGAGGTTTG TGCTAAACTT GGCCGGTCTG TATCACAAAT AGCTCCCTGT
706501 GAGCATAAAT AACATTGGCT CAGACCATGA GATTTGAGAT ATAATGACAA
706551 GTTCACAAGC AGTCACTTTA TCCAATCATC TCCTGCTCCT CTCTCTCTCT
706601 TAATTCTATA TTCCCAGGAA GGCTGGAGCA AGTTCATGAA GGGTGGGGGA
706651 CAGGGAAGGG GAATAATGAC AGATGACAAG ACGTAGGACT TCTATAATCT
706701 GTTCATAAGG AAGTAGTAAT TGAGATAAAT TCTTATCCAG TCACTGTAAT
706751 ACTTTTTAAT CAAGCCTGGT TGGGTCTTTT GTTTGGTTGC AGAGTAGCAT
706801 ATGAGAGCTG TGTGTTGGAA AATATGGGTT TGTGAGAGCA TATTCAATTA
706851 GATTATGCAA ATAGCATAGT CCTTGATAGA AGTCAAACAT AATATGCTTA
706901 ATTCACATAT TACCTTATTA TTCTTTAATA TCAAATCTCC TTGCTATAAT
706951 CTTGCTATTG TTTGCATGGA AAATGGTACT TTTAAAAACC TGTGGCCTTG
707001 GATAGACTCA GGGCAAAATA ATTTAATGCT CCTTGTTTGT TTGTTTAAGT
707051 GTTGTTTGTA AGCAAGAATT GTTAAGAAAC AGCTGCAGAA GTTTTGGGAC
707101 AAAAGATGAA ATTCCAGTAT AGATTTTCAA TGTCAAAAAG AAAAAAAAAA
707151 GCAGAAATAG AAGCTATGAT TTTGATCATT TTCTAGCCAA AAGGTTTAAC

FIGURE 3ZZZZZZZZ

707201 CTACTTCTCT ATGTACACTG CAAAGTTGTT TAGATTCTCA TTTCAGTCTG
707251 ACACCTTTGA CTGCCCCACT GTGGCTGCCG AGAACCTGAT TTAGGATACA
707301 CTATACATTC CTGGATTGCG CAGTCCATCA CTGTTCCTGA AAGGATGAGT
707351 ACTTTGTGCT TTCCAGATGA AAAACAAAAA AGTTTCAAAG AATCTAGTTA
707401 AATCCCAAAT AAATTTAGAT CCAAAATTAT ATCATTCATT TCCTGCCCAA
707451 AGGGACTAAA TTATATAATA AGTCTTTTTC AATTCCAATT TCAAGATCTG
707501 GTTCTTACCT ATTAAATCAC CCAAAGTGCT TTTACAGGGC TACCAAATAA
707551 TATTCCAGCT TTTAACTCTA AAGAATGCTG CTTTCTGCTG CATATTTCTT
707601 GCCTTCATCA TGATAATCCC ATGCTTATCT TTCGTCTTCT CTTTGAAGTG
707651 TTTTGTTATG ACCAGTCCTT TTTCCAAACT ATTATTAGTT CTGAAAAATT
707701 AGTGGTTTTG TTGGCTTTTA AGACCAAGAG TTTATTTTTA CTTGTTGGTG
707751 GGAGTGGGGG GTGGTGAAGG TGGGGAGAGG AGTTAGGGGA ACTTCAGGTG
707801 AAAAGGAGAA TTGCACTATT AATGAACAAC AGTGAAGGTC ATGTGGAGTC
707851 AAAATAGCAA AATGCATGAT GAAGAGTGGA AGTGTCCTGT TGTATTTCTA
707901 CCCTACTCTT CTTTAGTTCT AAAATAAAGG CAAAATGGAA GGACAGAGAA
707951 GAAGGAAAGA AAAAAAGAGA GAAGGGAGAG GGAGGAATGA AGGGAAGGAG
708001 AGGAAATAAT CCCTTTGAAC ATATTGGAAT GAGTTCTTCT TAAACGCTCT
708051 TGAGATGGAT TTTATTGTTA CCATTTTGCA TAAATGACTA CTCACAAGAT
708101 CATGTGAGAG CAGAAATTTA TTCCTTGCTC TAAAAAGTTG AACTATGTAT
708151 TTTTTCTTAA AATTGACTTT GCTGAAATAG GTTTTTCATA TTGAAATCTC
708201 AGTTTTGATT TATTAGCACT CCAAAGTGAA AATGTTCTCC AGTAGTGAGA
708251 AGGAAATGGA AACTTCACCA GGTAAAATTT CCCCATACCT CATAGTAGAA
708301 GTGTGTAGAA CTGAGCCTCT TTAAAGCCAA ATGCCTGTAT ATCTGGCCCT
708351 AAAATCCCTA GGAGGGCTGC CTATTAATAG AACTCTGTAG AGAATTCTCT
708401 TTTTAAATGA AGAAACCTCT TTAAAGAATA ATTATCCTCA CATTACTTTC
708451 CCACCAGCAG TTTCTGTTTC CTTTCCTTGA AGTCAGAGTT GAATGTATTT
708501 GGCTTGCAAA AATTCAATTC TGAGATATTA TTTTGATAAC GTCTGTGTGA
708551 AAGAGTTTAA AGAAGGAAGG CATAGAGATG GGAAAGGGTA AACTAAAAAA
708601 GGAAGAAGCA GAGGCAACTG GTGTTACTCG GGAATGGGAT GGCATGAACA
708651 TTCCAGCAAA TTCCTGACAT AATACAGATG AGAAGAGGAA ATAAAATAAT
708701 TGCTTTGAGT GGATATATCC CCATTCACTT TTCATTTGTG GAAGATGAGG
708751 TGAATTCACA ATTATTAGAA TATGAACCTC CTTTGTGATT ATCCAGCCAA
708801 AGGTTCAGGT TTCCTGCCAG CAGCCTAACC TGATGTGGTG GAAGAGGCCC
708851 AAAAGGGTAA GATGAGGCTA TTAACTCTAC TCTGAGTCAT ATGTAAGAGC
708901 AGATTTACTG TAATTTGAGG ACAGCGAACA AGCTTTCCCC AAAAGAAGCC
708951 CTCTCTATCA GGGTAAACTT TATTCCAAAG ACCACTATAA ACTGGGCCAT
709001 TGACCAAGTC CATCTTTGTC AGAACCTATT TGTCCAGGAC TCAATGCGCT
709051 TCTGAGGGCA TTGAGGAATG GAGGACTCAT GCCCCAGTAT AGCAGGCCAA
709101 GGCCTTCTTA GCCAGCTTTA GCCTGTGATG TATCTGAATG TCTAACAAAA
709151 ACTGCCTCTT GCTTTCGCAA TAATTTTTTA GTTGTAGCTA CTATTAGCAG
709201 GACTATATTT TATCCTTGAT TTGGATGACA TAACTTCTGT AGTAGTATGG
709251 CATTAAAGAT TTTCTGGAAA ACTCTTTTAA AAAGATTCCA GAGGAAAAAG
709301 ATGCATTTTG TAAGATAGAG CTGTACTTAA AATGATGTAT GTGCAGAACG
709351 ACAGAAAGAA ACCTAAAAGC TAAGCACAAC ACTATACCAA GAAAAATAAA
709401 AACTGAAATG ATTAGGTAGT GATTCATTGC CCCAGAAATA ATATCTATGT
709451 GAATGGTTAT GGAAACATGT TAACAATGCT GTACTTGTGT TTCCTTTTTA
709501 AGTACCTGGA ATACATTCTG ACCAAGTGAA CATATTATCT GAATTCTACT
709551 ACCCACCTAA GGATTTTAAT AAGGCTACAT TGGTTACACC TGCTCATTTT
709601 CTAATGCTTC ATAAAACACT CAGGCAAGAA CAGTTGCAAA GTACTTATTT
709651 TCAGCAATTC AGTTTTATCC ACGTGAACAT ATATTCTTTA AAGAATATTT
709701 GGGTACTTCT TGCCATACAA AATAATTTTC CTATTTAGGA AATAGGACAA
709751 TTTACCTAAT TGTTTTATTA ATTAATTATA CCTATAGTCT GCCTTTTCAG
709801 ACTAAAGGAG ATGAAAACAA ATATTCTCTA GACAGTACTA GCTTCTGCTG
709851 GTTTCTGCCA GTGTTGTAGC CCTGTGACTT AGAGGAATCA GGACAATTCA
709901 ATTACTGAGT TTGAATCAAG TCTTTGAAAG TACAGTACAG TGGCTTCTGC
709951 TTATTGCAAC CACTTTAGGA AACGGTTATT TGAGCCTAAT AGCTGACTGA
710001 TTCAATTAAA GGAGACAGGA AAACCATTTG CTAAGGCAAG CATTGTGCTT
710051 GTTATTCACT GCTATCATCT AAAGCGCATC TCTGAAATCA CAACTTTGTA
710101 AGCCAATGGC TCTACATCTT TCCCCTTCTC TGTCTATTTG GAGGCTGTGG
710151 CACAAATAGC CATTTTTGAC TTACTTCATC GGGAATTCTC AGCCAGGATG
710201 TGGAGTGGGC ATCTGAATTT GGGGTGAAGT TACATGAGCA ATTTGAACAG
710251 TACAAGATTC TAATACATCA AGACACACAG CCTTAGGGGG ATTTTTGCTC
710301 CCAAACAGAT GAAAATAACA TCTAAGGGGC CTATGCTTTG CGGGAAACAA
710351 ACTAAGAAAC AACAGCACAT TATTATTCTG TGTACACCTA ACAAAACGTG
710401 TAGAAAGCAA TTAGAGACCT GCATCAATTC TGGTTTCATC GTTAAACAAA
710451 ACATGCAGAA CTTGAATGAA GATTTAAAGA GTATCAGAAA CCAAACAGTG
710501 TCAGGTGCGG TAGCTCATGC CTGTAATTCC AGCACTTGGG AGGCTGAGGC
710551 AGGTGGATCA CTTAAGGTCA GGAGCTCAAA ACCAACCTGG CCACCATGGT

FIGURE 3AAAAAAAAA

710601 GAAACCCCGT GTCTACTAAA AATACAAAAA ATTAGCCAGG CGGGGTGGTG
710651 GGTGCCTGTA ATCCCAGCTA CTCAGGAGGC TGAGGCAGGA GAATCACTTG
710701 AGCCTGGGAG GTGGAGGTTG CAGTGAGCAG AGATCTTGAC ACTGCACTCC
710751 AGCCTGGGCA ACAGAGTGAG ACTCCACCTT AATATAAAAA AGTAAATAAA
710801 TAAAAACCAA ACAGAAAGTG ACATCCCAAA GAATCTACAT AATATAATTC
710851 TTGTTTTGAA CTTTAAAAGA CCAATACCTA ACTTCATCAG CCTAACTTTA
710901 TAATTGCTTA TATGATACAT GTGGCAATAA TCTTTGATCT GAAACAGTCG
710951 TTACCCATAA ACTCTGAATA TATATTTATA TATCTTATAA GAATAACATT
711001 AATTTTTCCA TCAGATCTTT TAATTTAACT TCAGAAATAA TTACATAGAT
711051 AAATTGAATC TTACATCAAA AAATAGACTA TCATAGATGT CAGCCTGTAG
711101 TCTTTTAAAA AGTAAAAGAA TGATTGCCTT TTGCAAATTC TAAAATGTAT
711151 GCAGGAGTTT AAAAAAAGTG GAGGAATTAA AAGTGACATG ATGTTCGGTA
711201 TATTCTTAAG GTACAGCTAA CAGCATTCCT ATTGCATTGG ATGTGAGAGA
711251 AAATAGGCAT GACAGAAAAT TCCAAGGCTT CCTGGGCAAT CTGAAATGGA
711301 AGAATGCAGG GAGGAGCAGT CGTAGAGGGG GAAAAAATTG CTAAATTTTG
711351 GATATGTTAA GTTTGATGTG CCAAGTGAAA ATATTGAGCA GAAAGGCTGG
711401 AGTTCAAGGA AGGGATCCAC ACTAGAGATA TGAATTTGGA AGTCACTGGC
711451 ACATCAGTGA TATTTAAAGC CATGAGACTG AATGATATTG CCAAGAGAAT
711501 GAGGAGAGTA GTGCTGGGGC ACACCAAGCT GAGAGGCTGA GAATATGAGG
711551 AGGAGGATAC TGAGAAGGAA TTACCAAAGA GGTAGAAAAA GAGTCAGAAA
711601 TGAATGGTGT CATGGGATCC AAGTGAAGGA AGTATTTCAA AGAGGAATGA
711651 GTTATTGAGG AAGATGGGGA CTGAGAACTG ACCATTTGAT TTAGCAACAA
711701 GAACGTCATT GATGTATTTG AAGGCATAGA TTTGGTGAAG TAATAGAGAC
711751 AAAGGTTTAA TTGGAATGGA AAAATGAGTG TATTCACCCT GAAACTAGGA
711801 AGTATAAATA ACTCTTTCAA AGAATTTTGT TATAAAAGTA AGCAGAGAGA
711851 TGGAGCACTG GTCACAGTGA AAAATGAGAT CAGCAAAACT TTTTTAAAGG
711901 CTTGTGTCCA GGGGAAGGAA AAATAGATGA CACAGAAAAA GAAAGACAAT
711951 CTTACTGAAA TTATATCCTT GAGTAGAGAA GAGAGACTGG AGCATAGTGC
712001 ACAGTTGGAA TGATTGGATT TAGATGGGAG TATGAACTGT TTATCTCTAG
712051 TACTGGAAGG AAATAGAGTC CCTGGGTCGA GATGTAGTCA TACCATTTTG
712101 TTGAAGGTCT CTTCAGATAG CTTTTATTTT CTCCATCATG TTGGAGATGT
712151 AATCAGCTAA AATCGAGGAT GAAGAAGGAG AGGTTTGCAG TTTAGAAGAA
712201 AGGATAAGAT ACGGAATCAT CTAGAAGACT GGGAAAATAA GTGATCTAGG
712251 ATTTTGCTGT ACAATGTGGC AGCCATGAGC CACATATATC TATTGAACAC
712301 TTGGAAATGT GACTTGAGCA ACTGAGGAAC TGATTTTTTA ATTTAAGTTT
712351 AATTAATTTT GATTTTAAAA TTGATACTCA TTCTTCATTT TTAAAAAACT
712401 TTAGGAATGT TTGGAAAAGC TTCAGTGTGT AACTCTGGTT TTTTAATTGC
712451 AAATTTTATA AAATCTAAAT ACAGATCAAG CATTTTAAAT GAAAATTTAG
712501 TATCCAAATT AAGAAGTGCT ACATGTGTAA AATACACACC AGATTAACAT
712551 TTACATTATA TGTTGAAATG ATAATATTTA AATATATCAT ATTAAGTTAA
712601 CATTGATTTT AATTTTACCT TTTTCTGTTT TTAATGTGCT TGCTAGAAAA
712651 TTGACAGGAT CAATGGATTC CTGGATTTGG TGGAGCTAAA GGATTATTGG
712701 AGACATCCTA CTAGAATAAG AGATAAAGAC AAAATGTGAG GCCAGGCATG
712751 GTGGCTCAAG CCTGCAATCC TAGCATTTTG GGAGGCCAAG GTGGGCGGAT
712801 CACCTGAGTT CAGGAGTTCA AGACCAGACT AGCCAACATG GCGAAACCTT
712851 GTCTCTACTA AAAATACAAA AATTAGCCAG GCATGGTGGC AGGCGCCTGT
712901 AATCCCAGCT ATTTGGGTGG TTGAGGCAGG AGGATTGCAT GAATCTGGGA
712951 GGTGGAGGTT GCAGTGAGCC AAGACTGCGC CATTGCACTC CAGCCTGGAC
713001 AACAAGAACG AAACTCCATC TTAAAAAAAA AAAAAAAAAA AAAAAAGATG
713051 TGGTTGTTGA AGAGTAGGCT TCTTGAAATT GAGGTTATGG AGGCAAAGCA
713101 GTTTGGTAAT GACAAGGTCC AGAGTATAAC CATGGAAGTG AATGACTAAT
713151 ATAAGGCAGA AAAGAAGAGG AGTTAAAAGA ACTGTAATTA AACAGGAATG
713201 TTATTACACA GATTATAATG TCAATATGAA TTAAGGGGAC ATTAATTCGT
713251 ATTAATGTTC ACATTCAGGA CAAGATGAAG GCAAAACCCA AAATACCTGA
713301 GGTTATTTAC TCTTAGGGAC TGTATTCCTG GAGGGAGGAA CTGTATTCAG
713351 TTCCTGAAGG GAGGGACTGT AGTCAGAAAC AAAGTCTTCA AGAAATGAGG
713401 GGTGGTGACT TGGAGTATTG ATAGGTGACT ATTACAGAGA GGGTGGTGAC
713451 TGGAAATCTG GTGCCTTGAG GTTCAAAGTA GTGTGTTTTA AGATAGGATG
713501 TGGGAAATAC CTCTCCCAGC CTAGTGTATA TGGCATATAG GACTAAAGAA
713551 AACAGCCATG ACATGAAAAT TGTGCAGAGG AAGATGTGTT CTCAAAGAAA
713601 ACTTCATTTT TGGTTAACAG TAAGTTGAAC AAAACTTTAG GGAAAAGATT
713651 GATGATGGGC CATGAGGTTC AGAGGGTGCA GTTGGAAGGC TCTCAGTTTT
713701 GAAGACTACA AAGTAGAAGT TGAGGATGGA CCCAGAAGAC GAGCGCTTCC
713751 CTGTGGTGAA TGACAGAGCA GGGATAAAGG GCCAATAAGA TCCTGTTCCT
713801 GCTATTCTTA ATGCATATTG TGGAGGCAAG GCTGTGAATA TTAAGGGTAT
713851 CTGAAGCCCT TCTTCACCCC TGCTGTGAAA GCAGAGAATC CTAGAAAGGT
713901 GATTTAATTA TAACTTTATT AGCCTCTTGA CCTGAAAGTT TAGAATCTAA
713951 ATCTAGAGAG GTAAAGTCTT CTGTATGATT GTGTTTTTGT AATTTCTGTC

FIGURE 3BBBBBBBBB

714001 AGAACTCTAA TAGTTTTGCT TTATATATTT TGATATTGGC TATTTGATAT
714051 ACAAAAATTA TGATTATTAC TTTTATATGA ATAATACAAG CCCTGATTTC
714101 ACTTTTGTTT TGATTGTCCT GAAATAGTTT TATATGTGTT TGTATATTTA
714151 TGCTGCATGA GTCATGTTGT TCTAGATATA TGTCTTACAA ATAACATAAT
714201 TAAGTCAGTG TGTACCTTTG TGTGTGCATG AGACCCAATC TGAAACTCTA
714251 TCTTTTAATA AAGATTTCAA CCCATCTCTA TTTATTGTGA TAACTATATG
714301 CTTAGTGTTA TTTCTGCCAT CTTAGTTTTC CAAATTCTTG TTTTTATGTT
714351 CCTGGTTTTG TTATATTAGT CAAAATAATT CTGCTTGTTT ATTATTTATT
714401 AGTGATTCTT AAGTTATACA TTGCAATTTT TCTACTAATG ATTTCCTTCC
714451 AATTGCTCTT TAGATGAATT TTTGATCTCT ACCCACTCTG AGAATGGAAT
714501 TTGCCCAGGT TTTACTTCTC TTTCCCCATA GTTGCTAAGA GTTTAGCAAA
714551 TAATCTGGAA TCTATTCAAT CTCTTTCCTC ATTTCAGTGG GAACTTGGAA
714601 CCCAGAGGGC GTCCCCACAC ACAGTCAGGT AGTTTCCCTC AGCTGGAAGA
714651 TAATCATGGA AAATTATGAG TAGCATTTGA AGTGTGTGGG TTCCTCCAAA
714701 GTGCCTAAAC TGATAAATCT CTATTTATAA TATGTGAAGT ACATTCTGTG
714751 GTACTGCTAG GCATGAAAAC AAGGTTGCAG GAAGCTGTTT AAAAGCATCT
714801 TTAAATATCT CATGCCTGAT TAATGTACTA TAATATGGCA CATGCTTAAT
714851 GAAAGAATCA TTAACGGGAA TATAATTAGA TGTTTAATTC AGTCCCTAGT
714901 CAATCGTTTG TTTTTAAATA CACCTAAGAG TAAACAACCT CAGATATTTT
714951 GGGTTTTGCC TTCATCTTGT CCTGAATGTG AATAAATGGA AACCTGTGGC
715001 ATGTACATAG CAGGATCAGA CACTTCAATA TACCAAAATA CATTTCCCGG
715051 AAAAATTCTT CCCTGGGACA CCCTAGAAAG GGTTTTGAAT TTAAATTGTT
715101 CAGTATTACA CTCTTGGTGA TTCACAAAGA CACATTAACT TATTAAAGGT
715151 TCTCAGAAGA TCCAGCATGA AGAAACCTGT TTAACCCTTT GTGACCCAAA
715201 GTGATTTGAC CAGGCAACCT TTTGCTTGCC TTACATGGGC AATTTATTTT
715251 CAGTGGAACA TATTTTGGGA AATGCTGCTA CACGGTGTTC TGTTGTAAAA
715301 TAGTTAAAGG AATCACTTTC CCATCTTTAG AGTTACATTT TATTACAGGG
715351 CTCCCAAAGT ACTTCTTATG TCTTTGAGGT CTTATAGAGT TTTAATGAAA
715401 ATCTCTGTCA ATTTTGACTT TGATTTCCCT TTCCTTCTAT CCTGCTCAGA
715451 TCTGCAAACA ACTCAAATAC AAACGTAGTG GTAGGAATGG ACTGAGAAAT
715501 TGGAGCCACA GCATGTGTGC TCAGAATCAC TCTTCTTCTC TGATAGCTAA
715551 GGATTTGGTA ACATGCCAGG CTCCTAATGT TCATTCTCTC ATGGCTTACT
715601 ATGCTCTCTC TGAGAGATTC CCATGTAGAA ACACACTTTC ATCAGGCCCA
715651 GCCCACAAGC ATGCCACCAG CCATTGCTGA TGTTATTTAG GACCTCACTA
715701 CAAGTGTGTA CATGACTGTC TCTCTGATTA GACTCTCAGT TCCTTGAGGG
715751 AGACATCTAA TGTCACTTTT ATTTGTATTT CTCTACTATT TGCAATATAG
715801 ATACTCAAGT GTGACTAAAT GAATGAATCA CTCAACAAAT GTGAAAAGTG
715851 AAAAACAGTT GAGTTTGCCA ACCTCTCAGT AATTTCAGAT TTAGACATTT
715901 GACATAAAAA TGGCAAGACA TGACTTTTAC TGTATTGTCA TGGTTTCTTT
715951 ACATATCAGT GTCCCTTTGT CTAAGACCAA ACTAATGGCA GAGATCATAT
716001 CCCCAGTGTC AAACCCAGCT TGTGGCACAA ACATTTTTTA AATAAATGAA
716051 TGAAGAACAA ATGAATGTTG GGACTTGGAA ATTCTCTCTT TGCCATTCAA
716101 ATATTTAGCA CACAAGGTGT TTAAATGAAA GTGGACATGA AATTAAAAGT
716151 ACTTTTTACA AAAGTGAACA AGTAAAAAGT CTTTGTACTT TCATGAGTTT
716201 CACTTTTGTA ATGAAAATCT ATCAAGCAGT TTTTATAACT GCTCTATCAC
716251 ACACAAGCAT AGGAAAATAT ACAAAATTAA CATCAGGGTT AACAAAAGGC
716301 AAATAAGTAA AGACAAAAAT GATAAGACAT TAGATTTTTG GAACAATAAG
716351 AAAAAAGCAA GTAGTCAAAT AGTGAAAAAT AGGAAGAGGA ATTTACAGAA
716401 GAGGAAATAC AAATGACAAT AAATATATGA AAACTGTTCA AACCTGCTAG
716451 TAATCAGAAA AATGCAAACT AAAACAAAAC TGTGTTTTCA ATCATCAAAC
716501 TGGCAGAAAT TAAAAAGATT TATAATATCC AGAGCTGGCA GGGATAAATG
716551 GAAATAAGCA CTTTCATACA CTGTTGGTAA GAATATAAAT TGATAAACCT
716601 GTTTTGAAGA ACACCTGGCA GTATCTCAAA TTTTCAATTT GCAACTTTTA
716651 GCCAACAAGG ACTCTCTTCT ACAGAAATAC TTTCACATGA GAATAAAGAC
716701 TTATGTACCA GATATTGATA GAAGCATTAT TTATGATAGA GAAAAATCGA
716751 AAGGAAATTA AATATCTTCC TATCAGGAAT ATTAAATTCA TTATTATACA
716801 TTCATAGCAT GGATACTATG CAGCCATTAA GGACAGTGCA GGCTTCAGTG
716851 GGATGACTTT AAAAGATCTC CCAAACATAT TATTTAATGA AAAAATTAAA
716901 AGCATATTGG AAATTAAAAA TTTGAGAATA ATACCACTTA TATAAATGTA
716951 TGTATGTTTA TTGAATAAAC GAATCTGTGA CTTAGAAAGG CTCTTTAAGC
717001 TACCAAAATA TGTGGTGCAT TGATCCTTTT TTAATAAAAT ACTTCATTAT
717051 AAATGAAGAA ATGGTACCTT AAAAAGGCAG CATTACATAT CCTGAAGCAT
717101 GATATGCTGA AGCTGGCATG ATACTCACTA AACTCAACAG TTCCTACTGA
717151 TTGGGAGAGG GATGAAGGGG AGCTAACATG TTTTACTCTA CTTAGTTCTG
717201 TATAATCTGA ATCTGTTAAC AAAAATATAT TACATATGTA ATTTTAGAAA
717251 GATATCTGCT ACTAGTAACC AGAAGGCTTC TTATAGCCAT TATATAAGCC
717301 TGCTCAGCTT AATATTTATA TGCCAAGCTG AAAGTTTATA ACTGATTAAA
717351 GAGATATAAG CAGCATCACA CAGTGACTTT TAGAAGCTAA AAGCAGCCAA

FIGURE 3CCCCCCCCC

717401 ATTGTTCCTT AAGAATGGAA AGCCCATCTA ATTAAGTAAT TAAAATTAAT
717451 TAAGTCTACT TCTTTCCCTC TTGCCTAGTC TGTGGCTTGG ATCACCTGTT
717501 AAGCTATGAG GCAGTACCCA AACTTCATGT AAAACTCTGA TCATCAGTGG
717551 AAAGTGAATG ATGTGATGAA AACCATCATG TCTTTAAACA GGTTGAAGAT
717601 GAGTAGAGAA CTCTGATCCC TCAATAGATC ATTTTTCAAA TCACCCTTGG
717651 AAGCTAAAAA TGAAATGATT TAAATGAAGT AAATAATTCC TAGAGATTAA
717701 TAAGGATATC TAGAATTGTT AGTATTGACA ACCCACCTGA AACATTCCTT
717751 TTTTTCTATA TATAATTGAC CCTTCTACCT ATTGACGTAA AGAACAGACC
717801 AATATCTATC AGGCCATACA ATTTTACAAT GCTGAGCAAG TCATGTCTCA
717851 ATTTCCTCCA TAGACTATGA TCCCTCATTG CTCATCTTGA AAATCCTTTT
717901 GCAGAAGTAA TGATCTCCCT ATTACATTGT GGTTGAATCA TTTGTGCTCA
717951 ATTGAGGGTG CGTTTAGTTC AAGCAATACA TTTTCCAGCA GTGTGAACAC
718001 TAACACAGAA GCCCACCGTG CACAGTATAT ATGTCACATG GCTATTTTTC
718051 CAGTGAAGGG CACTGAAAAA CTAGCTAAGA GCTTATTTTC CTCTTGATCT
718101 GTCATCTGTA TACTCTATGG ACAACTTGTC TGTCACTATT CAATTGTTCA
718151 AAACAAAATT CATTCTCCCG TATTAGACTA CAAGAATTGA TAAACAGAGA
718201 GATGACCCAT CTAGTTACAG CTGAAATGTA ACAAATGTCA GTAATTTGCT
718251 GTAACCTGAC TACAGCTTAA TAACAAATAC CAGCTACAAC GAAAACCTTC
718301 CTATTTTGAG TTCATTCTAA GATTTACAGA AAATTTTATA ATGCTTTATT
718351 AGATATCATT TTTATTGTAT GTACCTGCAT TTGTCAGTCA GAAACCTCTA
718401 GAAAACTTTG TTTCTCCTTT GAGAATAAAA AGAGGTCTTA AAATGCTTTT
718451 GAATTATAAT TTTTAATTAA GCTAAATTCT TCTAATTTCA GATAACTCAG
718501 ATTTCATTGG CTTCATGCTC CTGTGAATAT GTATAATTTT AATTGAATTA
718551 CAGTGATATT TTAGTTTCCT GACCATTATA TTAAAAAAGA GTTGTCTTTT
718601 CTGTAGTTGT CTGCCTTATA TCATTACACA TCCTCTTATA TATGCAGTAC
718651 CACTCATTTA ACAAAAATAG TTTCTAGTAA TAACTGTTAA TTGGGAAAAA
718701 TTACAGAAAA TAAACAGCAT AATAACCCCT TATACATTAG TACAGATGTA
718751 GTAACTATAA AAAGGATAAT CAAATCACCC TCTGAGGTAT TCAATTGCTT
718801 TTCATATTTG GAATAGAATT AAAGTAACGA AAAATGAAAC CTTACAATTT
718851 TACAGAGAGG AGAGTGGCTG GCAAAAATAA GCTTGTCATG GTTTAATTTG
718901 AAGTTTTCTA GCTTACTAAA AATTTTCTTT TTGAATTTTA AATTCCCTGA
718951 AGCATGGCAA GTCTTGGGGC AGGGTGGCTT GAGGGTTGAT AAATTCGGCT
719001 GCTCACCAAC CCCACACAAG GCCCACGTAC TTCTTTCTAT ATTTCTCCTT
719051 TGCCCTTCTG TATTCGGTTT AGCTCTCTTT CTGGCTGCAA GATGACCGTT
719101 GCATTTCTAG TCATCTCACC CAGACTTAAC ATTTCCAGAG GAAGAAAAGG
719151 AATTGTTCAT TAAGCTGTCC CAGAAGCACC CCAGCTGACT TCTCATGCTG
719201 CATTAGCTGA AGCCCATTCC TAAATCAATC ATAGGCAAAG AGAATGGGAT
719251 TACCACAAAG GATTTTGTGA ATATGGCTGT ATGGAATAGG GTGATTACTC
719301 AACACACTTA GGTGCTGCTT GAAAAGAAGA AATAATAGGT GAATGTTCAT
719351 TAGATGGATA TTAAACAGTA ACTGCTACTC CCTTTAGGTA CTGCTTGTTA
719401 TATACATGTC TACCTCCCCA TGAAAATATA TGTTCACTGA GAATGGATGC
719451 TACTTTATAT CCACATTAGT ATGTGCTTAA TTCTTTTTCG TACTCAGCAC
719501 GTTTCATATT TAGCAAATAT TTTTCAATTA ATGAATGGGT AAATTAATGA
719551 ATATAAGAAT AAATAATCAT AAGAAAAGAA GCAAATTTAC AGTGAAGTTA
719601 ACAAAGCTTA AGATTTAAAG GCCTTTGGAA AGACCTAGGA AAAGCTTTAG
719651 AAATGTGTTC ATATGATAAT CTACTGTTAA AAATTTTACA AAAATAAGAC
719701 ATTTTAACTA CAACTGGCTA AATTTGCTGA CTCTATGCTG ATTGACTTAC
719751 CCTCCACCAC ATTTCTGTAA GTGTCGAAGT GACCATTTTG GAAATTCAGT
719801 GATCAGAAAG CTGAGCTAGA GATACATTTA TTTGGAATTC AGTGGGACAT
719851 TTTTGTGTAT TTCTCAGTCA CTTCCACGTC TAATAATGTT ATCGCTACCA
719901 CTTGGTATAG GAAGGGTTTC CAGAAACACC CATCTGCCCT CCATGCTGAA
719951 TCACTGCAAA GCGATTTTTA AGAAAGGTGC AGAGCCAGAG GTGTTGTGTT
720001 TGAGCATGCC ATAGAGTACC TAGCCCTTAA AGAATGTTAA TAGTGAAAGA
720051 GAAAGATTGA AAGGGAGGGA ATCAGAAACC AGTCTGTACA AAATTCTTTC
720101 AATCATCAGA TACGTAAAAT TGTAAGCAGA GGATTCAGTT CATTACAGAT
720151 CCAGTCAAAA CAGAAGATCT CTCCTGTGAA AAATATTTTT GATAATGTGA
720201 TAATACAGCG TGTACAATTT TAAAAACCCC ATACCTTTGT TGTCACCTTT
720251 AACGGGTATT GCACGAAACT AGGTGTTGTA TGAAATGGAA TTTCTCAGAA
720301 TTCCTCTATG TGTAGGACAC AAATCTATAA CAATAGTGCT ATAGTAAGTT
720351 TGCCTATGAC AGCTGATAAA GAAATTTGAT AGGTTTTCCC AAATTTAGCA
720401 ACCACAAGAA AAATTTATAT GATGTCACTC ATAAAAAGTT ATAAAACAGA
720451 AATAAATTTG TCTAGACTAC TATTAATAAA CCAAATTTTG ACTAACAATT
720501 TTGTTATAGA AAATGATATT ATAAAACTGT TGTCAAATGA ACAGGTGAGC
720551 AAACTGTATG CATCCAAAAA TGTAGTCTCA GTGCAAGAAC CTAAGATAAG
720601 AATAAGAGTT AATTCCTGTT GAATGCTTTC TAAAGACTTT GCATTTATTT
720651 ATTTCTTTAA ATGCATTTAT CACAACTCCA TGAAGAAGTC ACTGTATCAG
720701 CAGGATGAGC TAGATTACAC TACAGTGTCA TATAACCTCC CAAACCTTAG
720751 TCACTATATT TGTAAAGGTT TATTTCTTGC TCATTCTTCA GATCTTGTAG

FIGURE 3DDDDDDDDD

720801 CTAGAAATTG TGCTGTACAT GGACATAATG TAGAGACTTA GTATGACAGA
720851 GGCCTCCACC ATCTGAAATA TCTCCAGTCA CTGTAACAGG AGGAAAGTGA
720901 ATGACAAATA GCACACTGAC TCTTAAAAAC TTTGACTGGA AGTGACACCC
720951 ATCATTTTCA CCTATATTTT GTCGACCAAC ACAAGTCACA TGGCCATGCC
721001 TAACTTCAAA GTAGTGGACA AAAACAATCC CTCCATTTAC TCAGAAAGAG
721051 AAGAACATAT ATTTGTAAAC AGCGAACGAT GATTACTACA GGTACTTTTA
721101 ACACATGGTA ATATATAGGA GAACTGAACC ATGGAGAAAA CCAAGTAACT
721151 AGCCAAAGAT TACACAATAA TCAAATGCAA ATCTAAGATT CATATCTAGG
721201 ATCAAGTCCA CATCTTACTA TTATTCTACC TCCTTTGATG TAAATTTTTT
721251 GGTAAATCTC TGAGCCCTGG AATGGCAAAT GGCATTACAC TAAGCATTAT
721301 ATTCTTGGTG AGAAATTATG ATGAGTAACT CAAGCAAGAT CTGTACATCT
721351 TCTAGTTTAG TGAACAATAT AGCTTAAACT CTCATTCATT ATATTCATTC
721401 ATCAAACATT TCTAAAGCAC ATTTAGAAAT TATAAATGAA TATAACTATT
721451 CATTTGTGAT GCATTATTAC ATCAATTTCA TGGAGAAAGA TAAGAGAAAG
721501 GAACTCTCTA ATACTAACTG GAGTTAGGAA TTATCTGGAG ATTAAAGGGT
721551 CAGCTATTGG ACATCTAGAA GCTAGAATGA CTCACTGCAA ATGATCAATA
721601 GTCTGCCTTT CCTTCCTTCC TTCTCTCCCT CTTCCCATAC TTCTTCCCAT
721651 CTTCTCTTTC ACAAAAATTT ATTGCATTCC TGGTAGATGG CAGGTATTAA
721701 GAATTGGAGA GATAAACAGA AATAAGATCT ATCCCTAGGG AACTCACAAT
721751 CACAGCAGTA AATCAGATGC ATAAATGCAA TATAAGAGTC AATGAGACAC
721801 TCTCAAAACC TTGTGAAATT CAAACTCTAC ATATATGCCT GATTTTATAG
721851 TGCAGGACCA GACTGTAATT TGCCAAGATA TGTTTATTAC AGTTCTCAGC
721901 CTGTGAATTT ATTAACATCT TCTCTACTGC ATAACACCTT TTGGTTTCAT
721951 TCACTGGTAT GTTTACAGCT GACATGCACT ATCTTTCCTG GCTTTTGTGC
722001 CCACATTTGT TTACACTGAC ACATGGTACT ATAGCTTGAT GCCTAGATAA
722051 GACTTCAAGT GTTTTTGCTG AAATCGCTCA GAATTATTGT AAAGAGATGC
722101 ATTTATAACC ATCAGGGAAC ACTGAATCTT GGAGTCTGTG TTCTTTGGCA
722151 TCTGTTAGTA AATATCTTAC TACCCTCACC AGCTTTAGGG TATACATTGT
722201 TTACCAGTGG CACAGCAAAA AATATCTCCC ATATTTTGTG GGGGGAAATT
722251 CTTTCTGGCT CTCACAGTTC TGAGAGTTGT TTACAGCCAG CTGGTAGAAA
722301 GTCTTACTTG CACTTCACCT GCAATGATTT GTGTGTCAGG CTTTTTGTCT
722351 CTTATGGTGC ATGAAGAGGA CAAATGAAAG TCCTTTCCCC TGCAATATCT
722401 TTCCTGCTCA TGAAAGTTAC TTTTCCAAAC TTTAATTACT GGCATGATAG
722451 CCTATCTTCA TTCTCAGTGT CAGAAGTCTT ATTTTGGTTT CTTTTCCAAT
722501 TACATCTTTT TCGAGTGCTT TATATATTTT AGTCTGCCGT AGATCCTTCA
722551 CTATAAAAAA AACAAAGATA ACATTTGTGC TATGTTACAG CAACTGTCTA
722601 GAGTCTATTT TATCTCAATC TGTGTCTTCA GTTTTTTCTA TAGAAGTACA
722651 AGTAGTTATA TATTTTTTAA CATACTATTG GACATCATGG CTATAATGTC
722701 ATATTAAAAA TGCTAGCATT TTGCAAGAAG TTCAAACTGG AAGCAAGGTG
722751 TTTTTTTTCA TTGGAAATTG TCAGAGATCG TAACGCGATG AAATATAATA
722801 AGCATAGTCT CTATTTCAGA ATGAGACGCT GAGGAGTTAT GACAAAAGAT
722851 CAAGGATCAA TTAAGTTATT TTTATACTGT ATTTTCCTTT CTGGGCATGA
722901 AGTACAACTT TCCACATAGT TTCTTTTCCA ACAGATGCTA TATAATTTTG
722951 TTGAAATGAT TAATGTAAAC AAAACAGATA ATTTGTTAAA GCTATTGGTG
723001 TGATAATGCT GCATAACAGG CCACCTCCCA AAATCCTCAG AGGCTGAAAA
723051 TACAAAACCT TTACTTCTCA TGTGTGAGTC TGCAGGTCCA CTGTGGCAGC
723101 TCTACTTAAA ATGTCACTTA GGTTCAGGTT TGCTCCACAT TTCTCATCCT
723151 GGGACCCAGG TTGCAGGAGC AGCAGGTATC TGGAGCATGC CTGTCTGGAG
723201 GTACAGGGCA AGAATGCCAG AGTGATTAGC CAAACAATGC AAGCACGTTA
723251 AAGCCCTGGT TGGAAGTGAC ACATGTTGCT TCCCTTACAT TCCATTGGCC
723301 AACCAAGTCT CCTGCCAAGC TCAAAGTCAG TGAGGCGGGG AAATATGCTT
723351 CATTCCCAGG CAGCAATGGC CAAGTCAGGG AAGAAAGGTA GATAGTATTA
723401 TTGTGTATTA TTGTGTATAA TACAACCTAC CATAATATCA GTTATGACTC
723451 TGTCTTCCCT GATATGATCA TTGCCAGTGG AAATTTCTGA TTGTGTCTTT
723501 CAATGTATGT CCAGAAAACT ACATTTATTT CTTCGAGTAT ATTTCTTCTG
723551 TTATTTGGTA TGTAATTTTC TACTTCTGCT AGTCTTTCAT GCCTTCAACC
723601 TAGATCAAAG AATAGTATGT GTTTCTACCA CAGTTTAATA GAATTGATAT
723651 AAAACTACCC AGTAATATGA TTCTTTCTAA ATGAGATTAT CACTTTTGTT
723701 AAAAGTAACA TGTACTTGTT CATGTCCTTT GTAGGGACAT GGATGAAGCT
723751 AGAAGCCATC ATTCTAAGCA AACTATCGCA GAAAACCAAA CACCGCATGT
723801 TCTCACTCAT AGGTGGGAAC TGAACAATGA GAACACATGG ACACAGGATG
723851 GGGAACATCA CACACTGGGG CCTGTCATGG GGTGGGGGGA GGGGGGAGGG
723901 ATAGCATTAG GAGATATACC TAATGTAAAT GATGAGTTAA CAGGTGTAGC
723951 ACACCAACAT GGCACATGTA TACATATGTA ACAAACTGCA CCTTGTGCAC
724001 ATGTACCCTA GAACTTAAAG TATAATAAAA AAAAAAAGAA CTAGAAAAAA
724051 AAGTAACGTA CTTCTACCCA CTTTGTTTCT AAATGGGATT ACACTTTTTT
724101 AAAAACTAAC TTGTGCTTAG CCTACTTCCA AATATAGGAA AGAAATAATT
724151 ATTTCATTAA AAAAGTAAAG CCCCTTTCAT TCATAAAAGA GCTATACCCC

FIGURE 3EEEEEEEEE

724201 CAATCCTTTT AAATATCTTT GTATTTTTAA GTTTTTTATT ATTCATTGAG
724251 TAAACCAAAT GTATAGATTA TGCCTATCAT TAAAATGCTC AATATAGTTT
724301 TACCTTTCTT CAAAATTCTC CTCTCTATAA ACTTTGACAT GCCTCCTATT
724351 TGCTATATTT CAAGCACATT GTCAATTTTG ATGGAATTAT ATCAGCTATA
724401 AAGATGTTAT AGATATCAGA TATTATGTGA AGTAAATGCA TTTTGCCAGA
724451 TAATACCATC TGCACCTAAG GAAATATGTG AAGTCATATG GAAGTTCACA
724501 GAATAATAAG TAAACTTCGA TGTTCATATT AGAGATCAGC CTAATAATTT
724551 GTGTTCATTC AAACATCTGT GATGTTCAGC TCATTCACGA GTCCCAGGAG
724601 ATGTGGTACT GCCAATAATT TGTCCTTCCA GTGTAATAGA GTATAAGAGT
724651 AACATGTGTG TTCAACTCCA TCAAAATGGA TAATGTGCTG GAAAAAAATG
724701 TTGTTTGATT TTGGCTAGAT ATATAAAAAT TAATTTTATT TAGAAGGGTA
724751 ATTTTTTGGC GGGGTGGGCT TGCCTGTAAT GCGGTAGGCA GGCCTCTCTA
724801 TGGCCCTGAA AGTGAAGCCT CTTTAGCGCT TCCTAGCTCC CACTCCCTGC
724851 AATGGCTGAG TGGCCAGGAA CCCAGGATCT AGCTCCAGAA GCTGAGTGAG
724901 CCCACCTTCC TCATTGCTGC ATTTTGTTTT TAACGACAAT TAAGATATTA
724951 TTTACATAAC AGAAATGTCG ATCATTTAAA GTGTTACCAT TTGATGATTT
725001 TTTTTGTATA TTTATAGAGT TGTGCAACTA TGACTGTACT CTAATTTTAG
725051 AACATTGTCA CACCCCCCCT AAAAATCTCA TACCCATTAG CAGTCATTCC
725101 CCATCCCCTT CCCGCTCTTT CCCAGCCCTA GGCAACTACA AATCTTTCTG
725151 TGTTTTCTGA TGGTGGACAA ATGGGATCAC CCAACACATG GTCTTTTGTG
725201 ACTTGCTTCT TTCGCTAAGC ATAATGTTTT CAAAGTTTGT CTGTATTGTA
725251 GCATGTATCA ATACTTCATT CCTCTTTCTT GCCTAGTAAT CTTCCATTGT
725301 ATGAATATAC CACATTTTGT TTATTCATTC ATCAGTGATG AACATTTGGG
725351 TTGTTTCTGT TTTTTGGCTG TTATGGATAA TTTTGCTATT GATCTTCATT
725401 TGCAAATTTT TGTGTGGACA CATGTTTTTA TTTATCTTGG GTATATCCCT
725451 AGAAGTGAAA TTGCTGAGTC ATGGTGGAGT TAAACAGGAT AACTCTGTGT
725501 TTAACTTTTT GAAAAGCTGC TAAATTGTTT TCCAAAGTGG CTGCACTATT
725551 TTTATCATCC CACCGGTAAG GAATGAGGGT TCTAATTTCA GGACATCCTG
725601 GCTAACACCT GTTGTTGTCT ATCTTTTTCA TTATAGCCAT TTCTAATGGA
725651 TGTGAAATGG TATTTCATTA TGATATTGAC TTGCATTTCC CTAATTACTA
725701 ATGATGTTGA ACATTATATG TGCTTATTAG CCATTCATCT GTCTTCTTTG
725751 GAACAATGTC TACTTTTCGC CCTTTTTTTT TTTTTTGGAG ACAGAGTTTC
725801 ACTCTTGTTG CCCAGGCTGG AGCGTAGTGG CACAATCGAG GCTCACTGCA
725851 ACCTCCACCT CCTGGGTTCA AACGATTCTC CTACCTCAGC CTCTTAAGTA
725901 GCTGGGATTA CAGGCTCACA CCACCATGCC TGGCTAATTT TTGTATTTTT
725951 AGTAGAGACG AGGTTTCGCC ATGTTGACCA GGCCGGTCTC GAACTCCTGA
726001 CCTCAGGTGA TCCACCCACC TCCATTTCCC AAAGTGCTGG GATTACAGGT
726051 GTGAGCCACC ATGCCCAGCC TTGCCCATTT TTTAAATTGA GCTATTTGTC
726101 TTTTTATGAC TGAGTTGTAA GAGTTCTTTA TATGTTCTGG ATACAAGTCT
726151 CTTATCAGAT AGTATATGAT TTGTAAATAT TATCTTCCAT TCTATTGGTT
726201 ATTATTTTCT TGACAGTTCC ACTTGAAACA CAGCAGTTTT AATTATTATA
726251 AAGTCAATTT TATTTTTTCT TTTACCACTT GTGCTTTTGG TGTTGTGTCT
726301 AAGAAACAAT TGTCTAATCC AAGGTCAAGA AAATTAACTA TTGTGTTTTC
726351 ATGTAAGATT TTTATGGTTT TTAGCTCTTA CGTTTAGATC CATGATCCAT
726401 TTTGAATTAA TTCTTGCATA TGGTATAAGT TAGGAGTCTA ATTTTCTTCT
726451 ATTGCATATG GATATTCAGT TGGCCCACAC CATTTGTTGA AAGACTATAT
726501 TTCCTCCATT GAATTATCTT GGCCCCTTTG TCTAAAATCA ATTGACCATA
726551 AATATTTGTA TCCATTTAGT TTTAGACTCT CAATTCTATT CCATTGACTT
726601 GTATGACTTT TCTTATGCAG TCCCACAGTG TCTTGATTAT TGTGTCTTTG
726651 TAGCAAGTTT TAAAGTCTGT TAATATGAGC TCACTAGCTT TATTCTCTTT
726701 AAAGATTGTT TCAGCTGTTG TGGGCCCCTT GTATCTTCAC TTAACTTTTA
726751 AATCAAAATA CACAATTATT TTTAGCCCCT TTTTTCTGTT GTTGGTTTTT
726801 TTGCCTGAAT TACATATAGC CTAGTAAATG ATTTCATAAG TTGAACGAGT
726851 GTGGTTAGGG AAAGGGTTAC TGACTTCTAT AAATATACAT GTATTTGCAT
726901 ACTAAAACAT CTCCAAGCCT CCAAGCTTTA GATATTATCA TAAAATTCTT
726951 GCTTAAGGAA AAGTATATTT TTGAATTTCA TACTCTAATA ACCCTAACAC
727001 CCAATTCATA TAGCAACTTA TTTATCTGAT TGTACTAAAA TATCCACTGA
727051 AACAATAGTT GTAAATTAAC ATTGATGTAA ACATGATTAA GTTTGGAAGA
727101 GCATAAACCA CATGACATCC TGAGCAGAAA AAGGAGAAAA TTCTCTTTCG
727151 GCCCCTTCCA GTATTCTTGC CTTGAACTTT TAAATACAAA AACTTATTTT
727201 GTTAACAAAA GCAACCATTC TCCTAAAACC AGAGAAGAGC AGTCATGAAA
727251 GGATTCACAA AACTAGGGAA ATAGTTGCTT ATTTTCATGC TTTGACCAAC
727301 AATCATGGTC TTCCCTTGGA TCTGAGTTTA TTTTGGCACA GAAGTGCTAT
727351 GGAGAAGCTT TCATAGTGAT CATGGCCCTA AGAAATTAAA AAACTTATAT
727401 TTATAGATTT AAAGTTAGAG AATTTACACT ATAAAATATG GAATTTATTT
727451 TCAGTATCTC TTTTGTTGTA TAATTTGTTT TTTATTTAGA TTGTGTCCTA
727501 CTGCATATAT GTTAAGCCAG GTTATTTTCA TCTGTCTTTT CTTTTTCTGT
727551 TCTTAATAGG TATGCAAAGT TTGTCTGGGT GAATATAATT AATTCCTCTA

FIGURE 3FFFFFFFFF

727601 ATCTTATGTA AGTCTTTTTC AATTACAGAT TTTTTTAGAA GGACTTCTGG
727651 AATATGTAAT AAACCTTTTG CAAATAATCA GTCTTTGATC AGAATTTTTA
727701 AAGACGATCC TTGGAGGGCA TTTGAAAAAC AAGGTTTTGT TTTATTTTTT
727751 CTGACTCAGG CCTTTTTATG GTACAGTTGC CAGAAATGTC ATAAATCTCA
727801 AAAAGGCCAT TCTTGTCCTG AACCAATTGA CCCTTCAGCG CCGAATCCTC
727851 AGCTACCTCA GGAGTCCTAC TGGACCTCAC TGCCATTTTC TGAATAATTT
727901 ATGTGATTTA CAGTGCCTTG TAAAAAGCAC TGAAACATCT CTCTGTGTGA
727951 CTCGTTTGCT TTTAATTTAT AGTGACATCT TTTCGTAGTA GTGGAAACTT
728001 GCTGAAAAAC TTTTCTGAAA CATTATGTTT TTCATTCATA CTCACATCAC
728051 TGTGGCTCAG TTTTCAGTGA CCTCAATTTT CTGCTCTGTT GTTTTTCAAA
728101 TTAAAAAATA CATATGGGCA GTTTCTTGAC AAAGTCACAC ATTAAATAAC
728151 ATTACCCATA GATCATTATC CTGTGTGCAC TCTGCCATTA CCAATGGTTA
728201 CCTGACCTTT AGAATTAAGG AGAGCATTAT GAGCATCTAT TGAGATATTA
728251 TAAGCTGTAA TATTATTAGC ATTTCTTAGG GTCAGCTGTA ATGTTTACAT
728301 TGCAGCTATG CTGGTGTCTC GGAGAAGGAC ACGTGTGGTT GGTAAGTGGC
728351 CCTTGTCAAG TCCTCATGAT GGTCTGATAA TAATAAAGAA AGTAAATGAG
728401 GAAAATGCTG TCTGGTTCAG TGAGATAGGC ATCTGTAAAG AAGATTGAGC
728451 ACATATGAAG TACTGTGCCC TGCAAAGAAC ATAAGGAGAT GCAGAGGGCC
728501 TGGCAGGATG GGTACCTCAT CATTTAAATT AGGCAACCAG GGAAAACACT
728551 GAGGATCATC ACCTGAACAG GAAGAGGCAC ATACATTGTT GGCAGAGGAA
728601 TTTAGATGTG TGGGTTAAGC AGAGCCAGTA TATATTTAAA TAAAACAGTT
728651 TTCTAATCAG AAGCCTGAAA TAAATTAATT AAATTAAATC ATATTTAGTC
728701 TTCTTCTGAA GGACAATTGT TTCTAGTATT TGAAGAATAT AATTAGGATG
728751 ATTTCATGAA TGTAATTATC AGCAAAAGTG ATTGCATCAA GAACATATGA
728801 ACCTTGTATG TTTCACTATC GAATTGGGAT TTTGTGTGGA AGAAGAAATG
728851 ATGTAATCCC AGCACTTTGG GAGGCCGAGG CAGGCAGATC ACGAGGTTGG
728901 GAGATCGAGA CCATCCTGGC TAACACGGTG AAACCCCATC TCTACTAAAA
728951 ATACAAAAAA ATTAGCCGGG CATGGTGGCG GGCGCCTGTA GTCCCAGCTA
729001 CTCGGGAGAC TGAGGCAGGA GAATGGCCTG AACCCGGGAG GCGGAGCTTG
729051 CAGTGAGCCG AGATCGCGCC ACTGCACTCC AGCCTGGGTG ACAGAGCGAG
729101 ACTCTGTCTC AAAATAAAAA ATAAAAAATA AAAAAAGACT ATTGTTTAGC
729151 AAGGTTTCAG TAAGCACTCA ATAAATGTTA GCTATTATTA TAATCATCAT
729201 CATCATCATT ATTATTGTTT TCTTCCACCT GATGGTTATA ATTGTGCTTG
729251 GTCAAGTTTA CATTGATTCG CATGAAGCTC TTCATTAAAG GTAATAGAAA
729301 TAAAGAACTC CTTTGTATCC AGCATATTGT CCCCATACTT GCCCTTTATT
729351 TTAGCTATTT AAATCACAAA TGGTCCCCTA TTAACTTTGA TTATTTTATA
729401 GCAAACACTT GAACAGTCAT CAGAAAACCT AGTTTCTAGT TCTATTCTGC
729451 CACTCACTAT TGTGTGACCT AGAGAGAATC TTATTATTTC TGGGCCACAG
729501 TTAGAATAGA TGTCTATGAG CCCTTTTCTT TTATTTCTTT TTCTTTTTTT
729551 TTTTTGAGAT GGAGTCTCCC AGTTGTTGGC GTGGGCTGGA ATGCAATGGC
729601 GTGATCTCGG CTCACTGCAA CCTTTGCCTC CCAGGTTCCA GCAATTCTCC
729651 TGCCTCAGCC TCCCGAGTAG CTGAGATTAC AGGCACCAGC CACCATGGCC
729701 GGCTAATTTT TGTATTTTTG GTAGAGATGG GGTTTCACCA TGTTGGCCAG
729751 GCTTGTCTCA AACTCCTGAC CTCAGGTGAT CCACCCGCCT TGGCCTCCCA
729801 GAGTGCTGGG ATTACAGGCG TGAGGCACTG CGCCCAGCCT GTGAGTCCCT
729851 TTCATATCTA ATATTCTATG GGGTAGCTCA AGGGGCAAAA TTTCAGGAAA
729901 AAAGCATTAT AATATATTGC ATTCACTTTT AATCTGTCCT TGGAAGTCAC
729951 TTCACTTCTG CCTCAAGCAA GACCCACATC TTGTTTGAGG ATGTCATTTA
730001 AGGGTAGCAT TGCAGGCTGC AGAAACTTCC ATTGTATAGT GTCAGAGTTG
730051 TGGATATCAA ACATTTACTC AGGATTAAAA ACGTGGCTTA ACCTACTTGG
730101 AACTAAAATT GAACTTTAAG AAGCTATTCT ATAACCAAGA CATAGATAGT
730151 TGTTGTCTTC AAACTAGATT TTACTATTTG TAGTGCCTTT GACCTTCATG
730201 CGAATTCCAC AGCAAATAGA GTCAACTTTT TTTAACTGTT TATCCCTGGG
730251 CAGTACCATC TGATATGAGT GGTATTCCAT CAAAATGTGT TTTTTTCCTG
730301 AGGAAGTCTT GCTGTAATAC ATCATCAGCA TGACAGCTAG TGTATTACAT
730351 ATTACAATAA AACATCCCCA GAGCAAAGGT ACATGTGATG ATGAATTATG
730401 ATAATATGTT ATTGTCATTA TGTTATCAGC ACTCAGAGAA TGATTTAGTG
730451 AGATACATCA TCAGTGAGTG AATATCTGAT TTTGTATTAC TCAAAAAATG
730501 ACACCATCAT GGAAAACCAC AAGCCTGTTC ATTTGATTAA TAGGGTTAGT
730551 GATATTCCAG TGCCAGAACT CATGTATGGT GGTATATTAA AATGTCCTTT
730601 GAAGCTGAAA ACAAGTTAAA GAAAGATGAG TCCATGAGGT GAGGTTGTAA
730651 AAGCACTGTC AATTTGAATA CTATTACTGT AGACAGAGTG TACAGTTAAG
730701 TATAAACCAA AAGTCACCCT TGTCTTTTAT TCAAACATTT GACAGTGATT
730751 TAGTTCTACT TAATTATCTG TAAGCCTGAT AACTTCTTTC AAGAAGCTAT
730801 CTATTGTAAG ACCACCGGGT TATGCTATAA ATCTACAGTC TACAGGTGAC
730851 ACTTTATTTA TTTAAGACGG AGTCTCGCTC TGTCACCAGG CCCGAATGCA
730901 GTGGCGCCAT CTCAGCTCAC TGCAATTTCT GCCTCCCAGG TTCAAGAGAT
730951 TCTCCTGCCT CAGCTTCCCG AGTGTCTGGG ACTACAGGCA AGTGCCACCA

FIGURE 3GGGGGGGGG

731001 TGCCCAGCTA ATTTTTGTAT TTTTAGTAGA GATGGGGTTT TATCATGTTG
731051 GCCAGGATAG TCTCGATCTC TTGACCTCGT GATCCACATG CTTCGGCCTC
731101 CCAAAGTGCT GGGATTACAG GCATGAGCCA TCATGCCCAG CCCAGGTGAC
731151 ACTTTATAAC GATATGCATT AATGCCCAAA ATCACTGAAC CAAACCAGAC
731201 ATATCACTAA ACTTTGTTGT TGAGTGACAG CTAATTTATT CAGGATATAA
731251 ACTGATCACT TTTCTTATAG AATCTTCTTT TGCACAGAAC CTTGTACACA
731301 TTAGGCACTG AAAAGATATT TACCAAGTTG AATCGATGAT TTTTCACATA
731351 ACTTTCTATA TTCAAAATCA CAGAAATCAC AAGTCTGACA CCAAACTTAA
731401 ATTAGAATAG CCAGACACCA TGGATTGCAA ATAGAAAACA ACTTCATTTT
731451 TCCCCAACAC TGCTTGTTCC ATCACGGTCT CATGAGCTAG TCATTCTGTA
731501 TCTTGCCACT GCTTTCTAGC TAAGGTCTCA GACCCATTCA TAGTGTGAGG
731551 GGCTATGAGA GGGAGAACAG AGAGCAGGAT AGATCTTACT CCATTGGTGC
731601 TCTCTTGATC TGGCATTGAT GCCCTCTGAG CTTGCTGAGT AATTAAAACT
731651 GACTTTTTCT CTCATGGAAT TCTTTCACAG GTTCTTTGAG GACCTCCTTT
731701 CACTCATTAT GCAAGTTTTT CCTCAAGATG TCTTAACATT CTGTACCTTT
731751 TAGTGCTTAT GACTTACGTT TACCTCATTA ATCTCTGTTT TCTAGCTATC
731801 ATTCCCTTCT GTATTGGCAC CAACTTACCC TAATAGGCAT CTTATACTTT
731851 TGGACAAAAT CCCTTTGAAG AAAACCTCTA AGCTGGCCCC ACCTCATAAG
731901 AACCATATCT GATTCACAGA AAATAGATTC TTCTGGCACA GAAGAATGTA
731951 TTCTTCTAGC AAAAACACAG CTAGATCCTA ACATAATAAT AATTATAATA
732001 ACTAAATTTT ACTGAGTGTG TACTATGGTC CAAGCGTTGC TACATGTGTT
732051 AACTTATTAA ACTTCCTCAA AAGAGGAGGG TAGTATTATT ATCCTCATTT
732101 TACAGATGAA GAAACTGAGG CATAAAGAAA CTAATTTACC CACTGTGACA
732151 AGACCCACTG TTGGGAAAGC CAAGCCTCAA CCATTGCTGG CCACAGTGTC
732201 AGTGTGCAGG CTCTTTGCGA TACATAATTG TAAATTTAGT ATTAGCACTC
732251 AATACTAAAT TTAGTTTTAA AACTAGCAAA ATATGGTTGT TCATCATTAG
732301 AACAGGTATT AATCAGTCAG TGCCTCACCT TTAAGCTTTT CCAGGCATAG
732351 ACTCAAAACA AGTTCGTTGT ATTTTCCTAA ACCTCATCAG TGAATGAAAT
732401 TTCTCCCCGT GGTCCTATTA CAGCTCCTCA CTGAATTTGA AATGAGGGGC
732451 GCCACAACAC TCAAGCTGTG TTCTCCAAAA ATAGTTATTT GTATCCCAGC
732501 CTTTTCTACC ACAGTGATCT GGGTATGGAG CAATGGGTAA CAAAACCAGT
732551 GTATTAGTTT CATTGTTTTT AAATTTCCTT TTCAAGCCTT GGAATAATGT
732601 AGGATAGGTT TATAATTTAG AATACTTGCT TATTATTAGT TTTTCTCTCC
732651 TTGGCCTTTT GGAGCCTCAG CCAAAATTGA GACAGAAAGA GTACTATTTT
732701 AACATCCTTT AATAAAAATA AAGGACATTT TCTGTAACCC AAAAGGCAAG
732751 GAAATGAGAA TGTATGGCTT CTAGGAACAA GTGGGATGCT TCTTAGTCCG
732801 TCATGAAAAC CTTAAAAGAT GAATGTGTCA CAGACCTCAA GAAATGTTTC
732851 AGGGTCATGA AAGGCATTTT TACTTCAGTT GATTTATGCG TGCAATTTCA
732901 GTAGGGCAGC CTGTGCTAGA GTGCTTCCAG GGATCCACTG GTTAGATCAT
732951 GATGAAGGTG GCATCAAACT GTCACTGTTC AATTTGGCTT GGAGGTGTGT
733001 TATCAATTTC TGAAGCATCT AATATACTCG ACTGAGCTGA CAGGATGTGG
733051 CACATTGTGG GTCCCAGCAA TCATTTTATG TCAATCTGTC CCATAGGTTA
733101 GGGTGCTGCT GGCTTTCCTC CCCAAACTGC TTCCACCTAA AACTTCCCAA
733151 GTTGACTCCC AAAATAGGTT GACTATTCAC ACCTGTTTTA TACTCAGCGC
733201 CTGGCCCTAG TTTTATTGGC ATGTTAAGAG AAGTGAAGTA AAATATTAAT
733251 GATTTTTAAA GACAAAAACA AAGCATTAAA AGTAGATAGC CAATGCATGT
733301 TTTTTGTTTG TTTGTTTGTT TTTGAGACGG AGTTTCACTC TTGTTGCCCA
733351 GGCTGGAGTG CAGTGGCACA ATCTTGACTC ACCACAACCT CCGCCTCCCG
733401 GGTTCAAGCA ATTCTCCTGC CTCAGCCTCC CGAGTACCTG GGATTAGAGG
733451 CATGCACCAC CATGCCCGGC TAATTTTGTA TTTTTAGTAG TGATGGGGTT
733501 TCTCCATGTT GGTCAGGCTG GTCTGGAACT CCTGACCTCA GGTCTGCCTG
733551 CCTTGGCCTC CCAAAGTGCT GGGATTACAG TTGTGAGCCG TCGTGACCGG
733601 CAGCCAATAT ATGTTTTCTT CATCTACTTA CTAATAAAGA AATAGACATT
733651 TTCTTCAGAA GAAAAAAATG CATGATAATC AAACTGCTTC ACAATCTATT
733701 TCTTGAATTA AAGGTTTTTT TTTTTTGTAA AACCGTATTT TGCCAACTAC
733751 AAATTCCTCT TCCTTGTGGG AAGGAAGTTT ACCTAAACTT GTCTTCTGTC
733801 TCTGAAGGCT GAAAAAGGAA ATTCTAGTGC TTAAAAATGT GACACAATAA
733851 ATTTCAGGAT AACACAATAG AGTTAATGTG TAAAGCTCTG TACATTTATA
733901 GGACATTTTT ATTCACGGTA TTTTATTGCA TTTTGACAAA AGGAGAGCAG
733951 TATTATATAA AGAAAAAGTA CTGGTTTGAA CTCTGAAGCC TGCATCTAAA
734001 TCTTGAATAT GGCAATTATC GGGCATGTGG CCCTCGACAA TTTTCCTGCT
734051 CTTTCTGACC TTCATTTTCC TTGTCTGAAA ATGGTGACAA TCATTTTATT
734101 AACCATAAGT AAACTGAGTA TAGGATCTCT GCCTTATTTA TTTTTGTATC
734151 CACAAGTCCT CGCACGGTGC CTGCCAAACG GTTCCTGCCA ATAAATTTGT
734201 CATGACAAGT AAATATGTCT GTGAAGAATT ATTATCTCTC ATTTACAGAT
734251 TAGCAGATTG AAGCTTAAGA TGTTTAAATG GCCCAGTGTT ACACAACCAG
734301 TAAGGAAAAT GCTATGGTCA GTTGTGAGAA CAGGATCAAA TTCTGGAAAT
734351 TGTGACATAT GTGGAGTCCA AAGCAGAAGC ATTAATCACT GTAAAAGAGA

FIGURE 3HHHHHHHHH

734401 ATATCCAGAT GCATATAGAC GAGCAGGGTT CAGAAACACA TACTTCTGGT
734451 TGTTCCATTG TGATAACTAG TTTGCTCCTC TTCACTTCCT GCAGATACTG
734501 ACAATTAGTA ACAAGTACTA TGATGCAGCC CCTCTTGGTG ATAAAGAATA
734551 TAGGACAGGT ATAATATATA GTTTCTCATT TTGAAATTCA AAAATGTTTT
734601 CATGAGTATA TTCTACATAG TGTTCAGCAG AGACACTAAT ATGAAAAAGA
734651 AATAATACTA ATAATTATTC TTACATGAGC ACAACACTGT TGCAAGCACT
734701 TTGGGTGCAT TCTCTCCTTT AATCCACCCA ACAATCCTAT AAGGTACTGT
734751 CATTATCTTC ACTTCATAGA TGAGAAAATT GAAGTATTGA GAGGTAAAGA
734801 AATTTGCTAA AAACCTCAGA GCCCATAAGT TGTGGAGCTA GGATTCGGAT
734851 GTAAGCAGTG TGGTTCAAGA ATCTTAACTC TTAACTTCTG TACTTTACTG
734901 CACCGTGTGG TGGGTAGAGA AACATAGGAC ACAATAACGG GAATCTGATA
734951 AACAGTTCCC AAGTCCAACA TAGAAATTAA AACTTAAAAC TGAGCAAGAA
735001 TATAAGGCCT GTACGAATAA GCTATGTTCA CAGAATGACC AAGAAACGTC
735051 TAGAAAACTT ATGAAAATTA ACTCCTTTTT AACCACTACT TCCCTTATGC
735101 CACCATTTTC TATAACACAT GTTCATATAA GCATTTAACA AAATGTACTT
735151 TGTCTGAACT TGCCTAATGA CTAGAATAAG TTCCCTGAAT TTTTAAGGGA
735201 TGGCAGAAAT ATTGATTATT TGGCAATTGC CTCAGCCCAA GTTCCCTGGA
735251 AAACAGAACT TCAGAATTTT AAATGATGAT GCTTTATTTT GGAAGTACAA
735301 AACCAGGGCA ACTGGATGGA GGGAAAATGG AAGTTTAGCA AGAAAGAATG
735351 TGAAGCAATA CCACAACATA TTACTGTGTT TGCTACTTCT TCATGTGGAC
735401 CACAAAAAGC ACAGCAATTA AGAGATGTGT TCGCTAACCA TGAAGAACTT
735451 CTCCAAATGA GCTGTATGGA GAAAACACGC TTCAAAACCA TTCATGTATG
735501 AAGAAAATGT GCTTCAAAAC CACTCATGGA AAGAAGCAAG AAAGATGTTG
735551 CTGTAGAACT CTTTTCTGTC TCCTGTTCTC CAGTGACCAA AGTTCGCCAT
735601 ATTATGAATT AATTCCCCCG CGCTTCCAAG TTGAATGAAG TGTCTCCTTC
735651 GATGACCATG TGGGATGCCA GATACCACAT TCTTCAGGGC TGTGTCACTG
735701 AAGTCCAGAA GTGGTAGAAG TCACAAATTC TGAGCTGCTG GACCTGGCTG
735751 GGTAGAGGTG AACCTGGCAC TCCTAAGACA AGTGCCCATC AGCTCTCAAG
735801 GGTGGAAGTA TTATCTAAGA AGCAGATAAA GCTAATGTAA GCTGACCCAT
735851 TATTCCGTAA TATTTGTGTA ACTTTTAGGA AATCAACTTT AGCTTAGCTG
735901 AACAGAATAT CTAAAGTCAA GGCTGCTAAC AAAGAACTAT CTCTTTTAAG
735951 GTACAACACC ACCTAGGGTG TGGGATATGG AGGAAAAAGA AATACACCAC
736001 ACACACATAC AGTACACATA TAAAATATAT GCATATATGT ATATTATGTA
736051 AAATTGCCTT TGATATTACA AAATATTCAG TTCTGCATAT TATAATCTAA
736101 TCACAATCAA TAGATGTACA AAGATGTAAT TTTCTCTGCA AATTAGATGT
736151 GGTTTTTCAG AGCCAGCGTT CCCATCACTG GTAGACCAGT GCAGGCCAAC
736201 CCTGACACAG CAGGGAAAAG AATGGGAAAG ACATTAGGAA GGAATAGAAT
736251 ATTAGGCAAC TCCACACAGG CCAAAGTCCA GGAGGCAGGT AGGTTGTGTC
736301 AGAGAGTGAA GAGAAGGATG TCCCTGTTGG TGAGAAGAGC ACAGTATCCA
736351 GAGCATCTGT CAGTGGGTAA TAAGTGGTTG TTCAGGAATG CAAACAATTT
736401 TTGTACTAGG CATAGTCTAA GTATTTTAGT GTGAAGGATT CCAGTATGAG
736451 TTTATTCTAA TGGAACCTAT AAACCAAATA GAGGAGGACA AATGTCCATA
736501 TATGAGAAAT GGACAGAGAT TGGTCTGAAA GAACCAAGCA GGAGCTAATA
736551 GACAAAAGGA TACCCACATG GTGATTCAGT GTTAAGTCTT ACAGCTTTAC
736601 AAGCTCCCTG TGTGGAGATA GTAGGGGTCC CAAAGCCTAA GAAAGAGCTC
736651 AGTATTGGCT GAATGTTCCA TCTTGGGAGG ATCAGAGGGC TTTGGGGGCA
736701 AGGAGTCAGA TTAAAGGGAC AGATGCATCA TTTAATTACT AAGTTTCCTG
736751 AATTGGAGTG CATTAACAGT TATATCCTTT CAGCAAAAAA TGTATTAAGC
736801 ACTTATTATA TCTGATATCT AATACATATT TTGCATTAAC AACTAATAAA
736851 AATTCTATAC TCTCGTATAT TTTGATAGTC TAACATATTT ATCTTCATCA
736901 TGGATTATGG GTCATATATA TGTATATATA TATATATAAT ATCATTTCAA
736951 ATAGTAAATT GTAATATGAG TACTATTTGC ATTTGTCTGA CAATGATATA
737001 CCTACCTTCT TTTTTTATAT ATACCTACCT TCTTGACTAT TGTATAGTAT
737051 AATTTATACT TGTTGTTTCA CATTCAGATT TATCTCTAAT CCTTTCTTTC
737101 TTCTTTTCCA TAACCCCTCA ACTATAATGC AATCAATTCC TTAAATCATG
737151 GGTGATAGGA ACAATGTATA GTGATTCCAA GCCATTTCCT CAAATTTATA
737201 AATTGAGTGC CAAGTTGAAA ATAATATCAG GTATCTACAT TTCCATTTAA
737251 ATGTTCTCAA AGGTGGCCAT TCCTGACAAC TGGCAAGAGT ATCCTGCTCT
737301 GACAGTCTGA CCCTTACACT CCCATTAAAT ATAAAAACAG ATCTGAATCT
737351 TTCACCCAGT TGTACTGTCA AGGCTAGTGT AACTTGCCTG TCATATAAAG
737401 CTCTTTGAAT CAGCCTGCCA AGAAAATATG ATTGTAGTAC AAATTTTAGC
737451 ATTCAGAAAT ATTCACTCCC CTTTCACTTA CATGGATTTT GAGGGTCAAA
737501 ACTATGCATT TTTATCAGGT GTTTTATTAT CTTTCAACTT TTGTGAAGAT
737551 CAATGTGTTA GAATAAAGAA CTTTTTTCTC CTTTAATGCC AAAGTGATTT
737601 GGTATAAGGG AAATACTAAT GAGCCATTAT ATTACTTATT GAAAGTTCCC
737651 ATTTGACAAA ATGAGAAAGT TTTATGTAAA GGATGGATGC AATCTTTAAA
737701 TTCCATAATG CTTTTGGAAA CTAAGCACCT GGTCAAAATA GATGAGCACT
737751 TAGAAAAGGG ATAAAAAATA TGGAACTTTG AATTTTCTTA GAAACCTGAT

FIGURE 3IIIIIIIII

737801 GCTTCTTCAG CAAAAACAGA AACTAAAACT TCTGACATAA ATGTAGCACA
737851 GAGAGAAACT TTTTCCCCAT TCATTTTAAA TATAATTGTG CTTATTATAA
737901 TGCCTAATGA TGATGGATGT TTGCATTTTT CTGTTATATA ACAGTACTGC
737951 AATTCAATCA CTATTTCTCT TATTATCATC ATACCAGCGT AACCACTGGT
738001 ACTTTTAGCA GGTAGCATGT AGGTCATTCT GGCTTCAACC CATGGATTCA
738051 TTGAATCACT TTTATTTATT TATTTTTTTT ACAGGTTAGA TTGTAAACTC
738101 CATCATTTAA CAGAATGAAC TATTAAAATG TCTAGGATGT TATCTTAAAA
738151 CAAACAAAAA TCATAAATAA AGAAACCCAA CTTGAACAGA GTTAGACTAT
738201 TGACCCCATT TTATCATCAA TAGCATGAAC ACCCACTGTA CTAAATGTAA
738251 GAAGTCTCCG TTTCCTTAAA TTATACAAGT TAATATTTTC TTTTTAAGAG
738301 ATACTCAGGG AAGGGAGGGT GAGATCATTT TAGGGCTCAT GAGAAAGAAA
738351 GATTGACAGC ACTGGCTGAA GTCAGGCAGA AAGCAGTCAG CCCTCGGGAA
738401 GCATTTCTGA CAGCTACGCT AATGCACTAC AGAGCTGACG TGAAACTTCC
738451 TCTAGATTCC TAAAAGAAGC CATTTGGGAA GAGCCTGTTG ATAATGCAAA
738501 ACTGGGCCAA ACGGTTCTGG TTGTGGACTG CTAGCAAAAG TCTACCCAAG
738551 ACTAACGGGA AATGACTGAC CTCATGTTTC AAATGAAAAA TATGAGTATA
738601 GCTATCCTCA AATGAAAGGA GCTTTCCCAC AAATTAGGAT GTTATTTTTA
738651 AAAACAGCAT ATTGGATTTA ACATCTCAGG TATTTTCCTA CAAGTAGGTA
738701 GTTTTTTTCT TCTTGAATTC TCAGGGCTCT GCTTAAAGTT CAATTTTGTT
738751 TACCAGAAAA GTATAAGAAC AAGTTTAATG CTGTAAAAGT TGTTTACTTA
738801 GAGCAATAAT ATGACAAACA GAACTGAATA AATAGCAACT TACACATCAT
738851 ATAAAGTTTT CCAGCCAACA TTGGCTGTAA AATCACCAGT GAACTAGAAA
738901 ACAAAACAAA ATACAAAAAT CAGGCTGAAG GATATAGATG AAAACCACCT
738951 TATCAAAAGC ACAATCACAT ATATTATCTT GTTTTGTGCC TCAATAATGG
739001 ATGAAGTTCA TGGTAACAGT AACTGCTGTT TTTGATTCCT TGAATTGGTT
739051 CAGCAACTTG ACCTTGGGTC CATTTAACAT TGAGCACATG TGAAGTCCTT
739101 TGCCCTGAGC AAATTTGTTT TCAGGGGGAA AAAAGTAAAA ATTGTTCGTA
739151 TAGAATTTCA TAACTGAGAG CACTAAAAAA CAACCTTTCT GAGTGAAATT
739201 TCTTTCTTTC TCATTCCCAG TACATATATA TATATGTGAG AAAGCAAAAT
739251 GAACAAAACA AAACAAAAAC AAAAGTTGAA TACTTTTCCT TCTTGCCCTT
739301 CAGGTAAACT ACTTACACTA GAATTTTTAA TATAGACTAA ATTATATAAA
739351 ACATATGAAT TAAATAGGAA AAAGTGGATT GCTTTTTAAA TATGGCATTA
739401 TTAATTTTAA ATATCTATAG AAAATCTTTC TAGTCTAATT AGCAAGTCCT
739451 TAGAGGATGT GATGATTAAT TTTATGTGTA AACTTGACTG GCCTAAGGGA
739501 TGCCTGGACA TCTGGTAAAA CATTATTTCT GGGTGCAACC ATGAGGATGT
739551 TGCAGGAAGA AATTAGCATT TGAATCAGCA GACAGCAAAG AAGATCTGCC
739601 CTCATCAACA TGGGTGATGG GTGGGTATCA CCCAATCCAT TGAGACCTTG
739651 GATAGAACAA AAAGGCAGAG GAACGGTGAA TTCTCTTTCT CTTCTGGACC
739701 TGGGATATCC ATCTTTTCCT CCTCAGACAA CAGAGCTCCT GATTCTCAGG
739751 CCTTCAAACT CTGACTGAAT TGTACCATCA GCTTTCCTGG TTTTCCCTCT
739801 TGCCGATGAC CTATCATGGG ACTTCTAGGC CTCCATAATT ATGTGAGCCA
739851 TTTCTCATAA TAAATATCCT CATATATCTG TCCATATCCT ATTGGTTCTC
739901 TTTCTCTGAA GAACTTGACT GATACAGAGT ATTTTCCCTA ATACATAAAT
739951 TTAAAGTGAA TGTAAATGGT GCTTCTATAG TATGTGATGG TCTTCAAAAA
740001 GACAATTTTT CTAAATTTTT TTATTATGTT CCTTGTAATT TTTACATGAC
740051 TAACTTTGAC TCTCTATTTA GATTATTTAA AGCAGAGTAA ATGGCATCCC
740101 GTTTTTATCT GTAATATGGG AAATATTAAA TCATGACTGA AATAGATATA
740151 TTTAATGTAT AAAAATGTGG TGTCATGTGA ATATTACAGA ATTATGAAGT
740201 AATGTTACTA ACTTTCTAGA CATGGCAAGA TTTTCTTATC TACTCTCCTA
740251 TTTTCCTTCT ATTTCCCCTT CAGCAATCCA CAGAGCAGCC AAAGTGATGT
740301 AAAATAAAAA TAACAAAACC AAACAAAAAT GAAAATTTTA TCATCCCCTT
740351 GCTTAAAGCC TTTCAATGGT GTTCCATTGC CACAAAAGAA GGTCCAAATG
740401 TATTTAATGC CCAAGGAATC TCTTCATGAT CTCTCCCCTG CTTACTTCTC
740451 TAGCCTCATC TCTCCCCCTC CTTTATCTCA CCTCTTTTCT CCAATTGAAC
740501 TCAACTTCTC TCAGTATCTC TAAATCTTAC ATTCTCCTCT CTACCTGGAT
740551 TAGTCTTCCC TCCCACATTT CCCATCCCCT CCTCTCTCAC ACCTCTTTCA
740601 TTCATCTAAC TCTATTCATC TTTCATAAGG TTCCAGCCTA GTCTTCATTT
740651 TCTCTGGAAG GCTCTCCTGA CTCTCCACTA TCATGGCGCC TCTCACATTT
740701 CATGGCGCCT CTCACATCTC ATGGCATCAT TTAGAAAAAC CTGTTACATG
740751 ATTAGCACTG TTGTGATTGT ACACTACATC TCTAACATTC ATTTAACCAA
740801 TATTAATTGA GCACTTATTA TGCTTGGGCT CATTTCTAAG CACTGAGAAA
740851 ACATCAAAGA ACCAAGCAAA CAGTCTCTGC CTCAGGGAAT TTATAATCTG
740901 TACACACACT GAATATTTGG CAGCAAGAAC TGAGTGAAAG AAAACAGGAC
740951 AGTAGAGAAC AAAAGAAAAA GAACAGATCA AGAAGCGTAT AGATTAAAAT
741001 AAGAAAAAGC CAAGAGACAT TCAAGATAAA AATGGAAAGG GCTCTTAGAA
741051 ATCTGGATTG ACCTTTTAAA AGACCTCACT CCACAATTGG ATAAGCCCTC
741101 TTTTATTTTA AATCATCTTT TGCCACTGGC TTGTGATATC ATTTGAAGAT
741151 GATATAAATT ATTTGTCGCT TCTTTCTACT TGCAGCCAAG TACATCCAGA

FIGURE 3JJJJJJJJ

741201 TTCTGTCATG TTATGCCACG CAGTGCTCCA GTGATGTCCT CCAAGAGCCA
741251 TCTGCTGTCC ACAATGAACA AGGCTTCAGA ACCCAAATGA TATACTTAAA
741301 CCTGAGCAAA ACAAGCTGGA AGCTTGTTTA AAAAGGCATT GCTTTGCCAA
741351 AATGTATTCA CTGGAAAAAT CTGCTATAAA ACAGTGAATA TATTATGCAA
741401 GTAAAATTAG ACCTTTCAAC CTGCTTGGTA TGATGCATGA TTGCACACAT
741451 TTACTGTAGT TGATTCTGCC AGATTTAAAG TGATTTTATT CTTTTTATGA
741501 GACATTTAGT GCAAAAGGTC AAAAGAGAGA TTTAGGATCC CTGTCATCCT
741551 TTTATTTTAG GAAAAAAAAC ACTCATTTAC ACCACTTTGG ATCACAAGAT
741601 ACAAATCTTT AAGCCACAAC AAACAAAGGA CAATAACAAA CAAAAAAGAA
741651 ATCAAACCAA ATTTTGTATA ATTTTGCACA TAAAAAAGTG ACAGATGCAA
741701 CCCAAATTAT AAAATTCTGT TTTGTAGGAA TGCGTTTCTA GTGATGGTAA
741751 CATTGTGAAA TCTCACTGCC TGCTATTCCA GTTGTCTAAC CAAGTCTTCG
741801 CTGTCATGGC TATTGCTGCT GTCTCCAACT TCACAATCAT CAGTTTTTCT
741851 TAGACTCTTA GTGGCAGCAA TTTCAGACAA CTTGCAATTT CTTGGACATG
741901 AGACGCTGTG TCGCCCTTCT GTGCCTCTTA CTGTGAACTT TGTTTTCTCT
741951 GAAGGGGTGT CCTAGTCTTT TTGTCTTACT AGTCAAATTC TGACTTTTCT
742001 TGTCAGCTCT ACCTAAAAGA TTACCTCTAT TCTGAAGGTT TTTGCCTCCT
742051 CACACAGCCA TCCCAAAGAA CTGATCCCTC CTTTGTTTTG TTGTTTTTTT
742101 TTTTTTGCTG CCAATTGAAT CTGGTACAAA CTTCTGTTAG ACCCCTTACC
742151 CTCTGTGCTG TTATTATTTA TTTATTTATT TACATCAATG TTTCTCTTAC
742201 TGTAACATGA GCTCCCTGAG GACAAGAAGC ATGTCTTCCT TGTGACTCTA
742251 GCACCTGGCA TGTGAGATGT GTTCAAGAAA CTCAAGACTA AGGGAATGAA
742301 TGAATGAATG CCACCAGTGA CCTTCAGTGC CTCTCTAGTG GTACCCTTTT
742351 TAAATTGAAA ATTTAGACTG AGAAATCCCT GCTTTCTTTT TTTCCTTATC
742401 ATTAATCAAA GTCATAATGA TGACTAAAAA GGAACTGAAA GTCAAAATGT
742451 GATTTCTACT TATATAGTAT AGTTCTGAGA CTGTGCCTTT CATTTTACAC
742501 CACTTTCCTA ATTCATCCCA AGTCATCCTC CCAGCAAATA ATCAATAAAT
742551 TTACATTATA ATCATAGCAC CATACTAAAT ACTGTGAAGT AGCATTTAGT
742601 AAAAAGAAGA ATGAAAGATC CTCCAAAACT CTTATAAACT TTCTGGGAGG
742651 ACAGTACATT CACCTTTTAA AAATTCAAAT AATAGTACGT AGAGGTTACA
742701 TGATGCTAGG TGCAAAATGA GTGAGGCAGA CAGTAAGTGT TATAGGCAGG
742751 CATAAGAGGA ATAATCACTT TGATCATAAA CCAGTAAGGA TCTGAAAGTT
742801 CCATTGGTTT TAGAAATGAG AAAAGTTGAA AATACAGCAT ATTGTGTTGG
742851 AATAATGGAA TGAAGAATAA AGGTTTGTAT AAATTTTCTC AACTATGAAC
742901 CTGAGGATGA GTAGACTGTC TTCCATTTTT TAATCAATTT ACCCCAGCTT
742951 TAAAACCTAC TTAAAATATA ATATGATTTG GCTATATGTC CCCACCCAAA
743001 TCCACCTCCA ATTGTTATCC CCACACGTCG AGGGAGGGAC CTGGTGGGAG
743051 GTGATTGGAT CATGGGACCA GTTTCCCCCA TGTTGTTCTC ATGATAGTGA
743101 GTGAGTTCTC ATGAGATCTG ATGGTTTAAA AGTGTTTGGC AGTTCCTCTC
743151 TCTCTCTCCT GCCACCATGT AAGATGTGCC TTGCTTTCTC TTCTCCTTCT
743201 GCCATGATTG TAAGTTGCCT GAGGCCTCCT CAGCCATGTA GAACTGTAAG
743251 TCAATTAAAC CTCTTTTGTT TTTACCCAGT CTGAGGTAGT TCTTTATAGC
743301 AGAATGAAAA TGGACTAATA CAGAAAATTG GTGCCAAGAG TGGGGTACTG
743351 CTATAAAGAT ACCTAAAAAT GTGAAAGCAA CTTTGGAACT GAATAATGGG
743401 CAGAGGTTGG AACATTTTGG AGGGCTCAGA AGGAGACAGA AAGATGTGGG
743451 AAAGTTTGGA ACTTCCTCAA GACTTGTTGA ATGGTTTTGA CCAAAATGCT
743501 GATAGTGATA TGGACAATGA TATCCAAGCT TAGGTGGTCT CAGATGGAGA
743551 TGAGGAACTT ATTGGGAACT GAAGTCACTT GCTATGTTTT AGCAAAGAGA
743601 CCACTGACAT TTTGCCCCTA CCCTAGAGAT CTGTGAAACT TTGAACTTGA
743651 GAGAGATGAT TTAGGGTACC TGGCAGAAGA AATTTCTAAG CAGCAGAGAA
743701 TTAAAGATGT GACCTGGCTT TTTCTGAACA AATACAGTTA TATGTGTACA
743751 CAAAGAGATG GTCTGAAATT GGAACTTATG TTTAAAAGGG AAGCAGAGTG
743801 TAAAAGTTTG GAAAATTTGA AGCCTGACCT TTTGGTAGAA AAGAAAATCC
743851 CATTTTGGGG GAAGAAATTC AAGCTACCAG CTGCAGAAAT GTGCTTAAGT
743901 AAAGAGAGGT CAAATGTTAA TCGCCAAGAC AATGGGGAAA ATGTCTCCAG
743951 GGCATTTCAG AGATCTTCAT GGCAGTTCTT CCCAACACAG GCCTGGAGGC
744001 CTAGGAGTGA AAAGTGGTTT CATTGGCTGG GCCCAGGGCC CCACTGCTCT
744051 GTACAGCCTG AGGACTTGGT GCCCAGTGTC CCAGCTGTGC CAGCTCCAGT
744101 CATGGCTAAA AGAGGCCAAG GTACAGCTCG GGCCATTGCT TCAGAGGGTG
744151 CAAGCGTCAG GCCTTGGTGG CTTCCATGTG ATATTGGGCC TGCAGGTGTG
744201 CAGAAGACAA GAATTGAGCT TTGGGGGCAT CTACCTAGAT TTCAGAGGAT
744251 GTATGGAAAT GCCTGGATGT CCAGGCAGAA GTCTGTTGCA GGAGCAGAGC
744301 CTTCATGGAG AACCTCTACT AGTGCAATGT AGAGGGAAAA TGTGGGGTTG
744351 GAGCCCCCAC CCATAGTCCC TACTGGGGCA CTGCCTGGTG GAGCTGTGAG
744401 AAGAGGGACA CTATCCTCAA GACCCCAGAG TGTTACATAC ACCTGGCCCC
744451 ATGCAAGTCA AAAAAAAAAA AAAAAGCCAC AGGCACTCAA CGCCAGCCTG
744501 TGAAAGCAGC CAATGGGGCT GTACCCTGCA GAGTCACAGG GGCAGAGCTG
744551 CCAAAGGCCT TGGGAGCCCA CTTCTTGCAT CAGTGTGGCC TGGATGTGAG

FIGURE 3KKKKKKKK

744601 ACATGGAGTC AAAGGAGATT ATTTTGGAAC TTTAAATTTA ATGACTGCCC
744651 TGTTGGGTTT CAGACTTGCA TGGGGCCTGT GGCCCCTTTG TTTTGGCTAA
744701 TTTCTCCCAT TCAGAACTGG AAGATTTACT CAATGCCTGT ACCTCCATTG
744751 TATCTTGGAA GTAACTAGCT TGTTTTTGAT TTTATAGGTT CATAGGTGGA
744801 AGGGACTTGC TGTCCCAGAT GAGACTTTGG ATTTGGACTT TTCAGTTAAT
744851 GCTGGAATGA GTTACAACTT CGAGTGACTA TTGGGAAGGC ATGGTTGCTT
744901 TTGAAATGTG AAAAGGACAT GAGATTTGGG AGGGGCCAGG GTGGATTGAT
744951 ATGGTTTGGC TCTGTGTCCA CATATGAATT TCATCTCAAA TTGTAATCCC
745001 CACATGTCAA GGGAGGGATT TGGTGGGAGG TGATTGGATC TTGGGGGCAG
745051 TCTCCCCCCA TGCTTCACTT CTTGTGATAG TGAGTTCTCA TGAAATATGA
745101 TGGTTTAAAA GTATTTGGCA GATGCTCCCT CACTCTTACT CTCTTCTGCC
745151 ACCATGTAAG ACATGCCTTG CTTCCCCCTC ACCTACCGCT ATAATTGTTA
745201 AGTTTCCTGA GGCCTTTCCA GCCATGTGGA ACTGTGAGTC AATTCAACCC
745251 CTTTTGTTTA TAAATTACCC AGTCTGAAGT AGTTCTTTAT AGCAATGTGA
745301 AAACAGACTA ATACAGAAAA TATGAGCATT TTAATAATTC TTTCAGCGAA
745351 AGTCTACCTT TAAAATAGAT TTATTTGTAT TAAACATATT TTGGTATTTC
745401 CAGCTCTAGG TACTTCCAGA CATTTTTCCA AGTTCTTCTC CACCTTTGGG
745451 GGTGAGCCCT TCAGCCCCAT CCTTTCCCTA GAGTGATGTT CTTCAGTCTT
745501 TCAGATGACT GTGCCCTCTT TCCTATTGAG TGTACTTCTG ACTGAGTAGC
745551 TGACCCCAAA CAGACTGCCT CTAAAGATGT CATTCTTCAT CTTTTCTCTC
745601 CTCCTCAGAT GATAGTCAGA GCTAGCCTTT CTGACAATGG TAATTTAAGG
745651 TCACTGTTCC ATTCTAAACC AATATATCAC AACACTACAT GCAATAGCTG
745701 CAAAAGAAGA CCTGCTGCTC AGATATGTTC CAAGCACTGT GGATCTGTCA
745751 GGAACAGTCT AACTTAATGT ATAAAGAGCC TGTGGGCATA ACAATGGCAC
745801 AGGAAGCAAC TGAGCTCTGC ACTAACACTT CCTGTCTGTT TCCTTAGACA
745851 GAAGTGAAGG TTGTTCCCTC TGTTTTAATT CACTGGGGTA TTACATATAT
745901 TAAAAAATCA TAGAATATTA GACCTTCATA TGAACTACAA GATACAAGTC
745951 CAGTTCCCTC TATTTACAGA AAAATCTGTA ACTTGCCTAA GATCACAAAA
746001 CAGATTAGAG AAGAAAGAGG GCCAAGAAGC CAGGATTCAG CTCTACTGTT
746051 GTTTTGTCTC TCTACATTGC ATGCTGCTTG TCCAAAACAA GCACCCCAGG
746101 ATTTATGAGA ATCACCCTTG TGTATACTTT GGAGTACTAT TCAAGTTTTC
746151 CATTCTTTTT GGATATTTGT TTTTAAGCAG AGTTTGCAAA TACTACTAGT
746201 ATAAATATAG GTATGCTTCA CTTTATGTAA TTTATTTTCC TAATGACAGG
746251 ATCTAAATCT TTTCCTCAAA TAATTATCAT CCAACCATGG ATAGAGATAG
746301 ATGGTGTATC AGTCAGCGAT ATGGTTTGGC TGTGTCTCCA CCCAATATTC
746351 ATCATGAATT CCCACGTGTT GTGGGAGGGA GCTGGTGGAA GGTGGTTGAA
746401 TCGTGGGAGT AAGTCTTTCC CGTGCTGTTC TTGTGATGGT GAATTGGCTT
746451 CACAAGATCT GATGGTTTTA AAAATGGGAG TTTCCCTTCA CAAGCTCTCT
746501 CTCTGTCTCT TTAGCTGCTG CCATCCATGT AAGACGTAAC TTGCTCCTCC
746551 TTGCCTTCCA CCATGATTGT GAGGCCTCCC CAGCCATGTG GAACCATGAG
746601 TCCACTAAAC CTCTTTCTTT TGTAAATTGC CCAGTCTCGG GTATGTCTTT
746651 ATCAGAAGCA AGAAAATGGA CTAATACAGT CAGGATTCTC CAGAGAAACA
746701 GAACCATTAG GATATATATA TATATATAAT TATTGGGAAT TCATTCCCGT
746751 GATTATGGAG GCTGAAAAGT CCCAGGATAC GCCATCTGCA AGCTGGAGAA
746801 CCAGGAAAGA TGATGATATA ATGCAGTTTT AACCCAAAGG CTAAGAAAAG
746851 GGCAGGGGCA GGGGAGAACT TGTATAGGTC CCAAAGTCCA AAGGTCTAAG
746901 AACCTAGAGT TCTGATGTTC AAGAGCAGCA GAAGATGGAT GTCCCAGCTC
746951 CAGAAGAGAA AGCAAACTCA CTCTTCCTCC ACTCTTTTGT TCTATCTGGG
747001 CCCTCAGTAG ATTGGATGAT ACCTGTCCTC AAGGAAAGCT TCTGTACTTA
747051 ATCTACTGAT TCAAATGCTA ATGTTTTCCT CCAGAAACAC TCTCACAACC
747101 ACACTAGAAA TAATGTTTTA CCAGCTATCT GGTCATCCCT CAGGCCAGTC
747151 AAGTTGACAC ATAAAATTAA TCATCACAGA TGCTACAGGG ATTAATCATT
747201 GCTTTGTATT AGTATTATTC TCACAGTGCA ACCTGATAAG AAAGCAAAGT
747251 ACCCACTCTT TAATGTTACA CATCAAATTG ATACCACTGA TATAAAAATG
747301 CTTTATAAAA CTGTCAAATG TTATATATCT GAAGAGTTAT ATTTTCATTA
747351 AAAATTTAAT GTATTAAATA TCTCAATATT AACAATTGCC AATGGCCTGG
747401 AATAATTAAT CTTTCACTCC CCTTTATGAT TTATGTTGTA CATTTTTTAA
747451 AAATAAAATC CATTACTTTT GTGTTAATTT CCATAGTTCT TTGCAATAAA
747501 TACTACAAAT AAGAAACTTT AAAAATCATT ATTTAAAATA CACTGGGGAG
747551 GGTAGGCTGG GGTAGGTAGT CTTCTGTACA GCTGGGTTTA AAAAAGTGAG
747601 AGAGAGAATA CCTCAAGAGA GATGTTAGAG AAGAGTACTG CTATCCAGAT
747651 AAGAGTGGGA ATAGTATTTC TTAACTCATT TTAACATATT ATCAGCTATC
747701 CCCCTGAGTC TTTACCATGC AGTATGTTTT CAAAACCATA AGAAGTGATA
747751 GGTTGTTTTG AAAAAATTGC CTGTACTGTC AGTAGTGTTT AAGTTATCTA
747801 AACTCAGATA CAATGGCAGT TCTCATAATA AAGTACATAT TTATTCTCCC
747851 ACACTAAAGT AGCATTGTGT CCTACATTAT CTACCTTATA GGATGAAATA
747901 GAAAATCCAC TTTTACAGAT GTCCCCCAGA ATAGTGTTAC TCACTTAATG
747951 ATGTAGCACC TATGTTCTCA GTGAAAGAGA ATACTGAGAA ATAGATGGCA

FIGURE 3LLLLLLLL

748001 ATGAATTATT TTCAGGAGCA ATTTAAGAGG AAGCAGGTGA AAAGGATCCT
748051 AATTCTTCAG GGTTTGAATA GCACGATAAG CAGTGTTTTA TTACAGGAAC
748101 AACAAAAAAT TAGCATTCAC TGAGCTGCTT ATACATTTAA ACAATGAATA
748151 AAAATGTAGT GTAGTTCTAA GTATTGCAAA TGAGGAGAGG AGGAGGAGAG
748201 TCTTTCCATA GTTAAGAATT TTTTTAGCAA GTAGAAAACA AAGCTGATGA
748251 TTTAGCTATT CATGTTTATT TGAAATTGTT TCTCATCTGC CCCTATTCTC
748301 TATGAAAAAT ACACTGTAAA ACAAATTTCA AAAGGAGATA ATTGTGTATT
748351 TCATAATCAG ATGGAAGCGT AGGCTTAGAG TTAGGGTGGG GGAGGGATAG
748401 GGCAGCAACA CCGACAGGGC CAGGAAGATA ATGGAAATAG GTCAAGTGTG
748451 TCTGATGAAA GACTTGGTGA GAGGGTGGAG CAGACGCTCT AGAGAGCCCA
748501 TGCCCTGTCT AAAGACATTT AGTTTCAGTT TAAGGAAACA AAATAAAAAT
748551 AACTTAGCCA TGAAAAGCCT AAATTCAGAC CTTTTTCAAC CCAAGGACCA
748601 ATAGTTGGTG AGCTCTGGGT TCATGAAATA TAAAACCCTG AGACCTCAGT
748651 GAACACCCTC ATGAAGATCC TCAGCACACA TAATGAAAAC CTCAAACAAG
748701 GGAGAAAAAA TCTCATATAA GATTTTTTAA AAATTTAGTT TCATATGTTT
748751 GTTACCTAAA ACAATGCTGT TTACCATCGA TTTCTGCAGT GCTTATCAGC
748801 TTATAAAAAT TGGTTATTAA GAACCAATAT TTTAAAAATA CTGTGCCAAA
748851 AAAAGGTTCT TTTGCTTAGG GTAAGAGTGT TTTTAATCTG GCATCTGTGA
748901 ATCTTGAGAC ATTGATACGA AATTGTGTGC CCCTGCACAA TCCCATGTGC
748951 ATGCATGCAT GTCTGTACAC ATATGACTGT GTCTACATGT GTATTTCAAG
749001 GACAAGCGTT TCATAGCTTA CCTAGTGTGC CATGACCTCA GAAAGAGAAT
749051 AGAAACACAC AGGAAAAGCA AGCAATCCAG ACACAATCCT TATCAGGCTG
749101 GTCAAGCTGC AGACAGAAGT CTGGCCTGCC AGCACTCAAC CATAAATGAT
749151 ATTATATGAT GACAGAATTC TACCTGTGAA ATATTAAGAT GAATGCAATT
749201 TGTCTCCAGT CTTGGAAGGG CACTGGGAGG ACAATGGCAG GGGTTTAAGC
749251 ATGGGACTAA ACTCACTGGA CCAAGACACA CAGATTTCCT TGAACTGGGC
749301 AAGACAAGGT CTAAATTACT AGAACTGTGT CAGAGACTGT CCATCAGCAG
749351 AATTGACTTT GCACCTCTGA CTCCTAAAAT CTGCTGTTTG AGAAGATCAT
749401 CCCTAAGCCT GGGCATGGTA GGGGTGAGTT CAGTGATTCC ACATGAAGGA
749451 ATTGAGATGC TGATCTGGGC TGGAAGCCAA ATGAGTCCAA AAAAAGACAA
749501 ACTTTGGATA CATAATTAAG GAAACAGATA ACATTTACTG AGTGTACACT
749551 GGGTGCTGGC TGCTAAGAGG TGCTTTATGT GTACCATCTC ATTTAATCCA
749601 CTTAACAAAT GTTATGCTAG AAGCCAAAAT ATGAGAAGTT TCTCCTTTGT
749651 AGCTATAAAT GAATTCATTC CACTATTAGC CTTCAAACTT TCTTCAAGTA
749701 AAGACAGATA TTATTTCCAT ATTTCAGAAA AGGACAAAAC TTTCCAGAGT
749751 ACCAAAGTTT CCCTAAATTT GTAAATCTCA ATAAAGGAGG AATACACATG
749801 CCTCTCTGAA AGAGGCTGGG CACATAGTTT TAAAACACAT GCACAATATA
749851 ATATCGTTTT ACACTATAAA ATAATTTGTT GATTTGGGAA TACAAACTAG
749901 GAAGTGATGC ACGAGAGATG GATTTCTTTC TCAAGATCAG TGATTCTCAA
749951 GAGTAAGAGG ACTATCCCCC TAGTTAGGGT TGTCTGTTCT AACTAGTGAA
750001 TTTGAGATCA TTCTGTGACT TGCTGTGACT TTTTGGGACA CCATAGTGAA
750051 TTAAGGCAGA AGGCCCCAGA ATGCTGACCT CTCCACAAAA GCTGCTGAAA
750101 CGAGACCACC TCTGCCACAC ATAATCCCAC CAACAAGAAA TTATAACTTA
750151 AAGTCATCCT CCAGTAAGCA CATTAATGCC TTCTTTGTCT GACATCAGTA
750201 AGACTCCATA TGATAAGCTT TCCAAATAAC CAATGGTTAC CCATTAAGAG
750251 TTAAAAAATA AAAAGAAAGA AAAAGTCAAA CCTTGGTTTC AAACCTTTCC
750301 AATATATATT ATTCATGCTG TTGTCTTCTT AAACAAAGTG TTTAAGTTAC
750351 TTTCCCTCTT GCTTACCACT CACGATCACC ACTGTAACCA TGAATTATTG
750401 GCCAGGGATG TAACCTAAAG TGTGCTTGCC TCCTTTTCTG TCTGCCATCA
750451 GGCTGTCTGC TCACACGGTC TTGGTACCCA CTCGTATGGC CTATCTCTTT
750501 ACAATTTAAT GAGAGCTGAG AAATTGTGGG CAAATGTCAA AACTCATTAT
750551 AGTTTACTAT TTTATGGTCA TTAATTCAAA TCCCTTCATT TTGCAGTTCT
750601 GAAATCTAAG ACTCCGAGGA TTAAGCCTTG CCCAAGGTCA CACAGTGAAC
750651 TATAGTAAAG TTGCATCTTA CAATTTGTAT TTCAGAAAGA AAAATATTGT
750701 TTAGTCAAAA TTGCTCTTAA GGATTTTTTA AATTATGCTT TAGTATAATA
750751 TATACTCATT AATTGAGTAC TATAGAGATA GATTGAGAAC AGAGCAAAAG
750801 TCTACAGACA GATTACTGTC TATTCAAACC GTTCACCTTC AAGATAACCA
750851 TCAAATCTAG TAAATGAGAA ACAGAGAGAG ACATTTTAAG TGTTCTTGCT
750901 TCTCTACAGA ATTTTTCCAT TTGGTTCCAG TATTAAGCCT CTGTATCCTT
750951 ACTACATTTC AATTGATTGG TCTCTCCTCT GCAGATTAGA GGCTTATATA
751001 GTAATACTCA GGTGTTAAAT GCACCTATAA TACAACTCCA CTCTGGGGAT
751051 ATAGGGCAGA CAAAGATACA CAAATATACA GTACTTCTTG TTCCCTCATT
751101 AGCACTTTTT CAGCTACAAC TACCTACCTA TTTATCAGAC AACAATCTCT
751151 GAATATGACT TGGAAAACAA AAACACAAAA GTTTTACTAA TAAACATTTT
751201 AGTACCCCTC CAGTTTACTT ATTTCCTGTT TTTCTTTTGT TCCCTAAGTT
751251 ATTAAGTTTG CTCTGTAAGA GAAGTATTAG TAAATGAGAA GCCATTTGAG
751301 TTACATTCAG TCACTTTGAT TAGCATCTTT GGTAATTTTT TTCTCTCTCA
751351 TAAACATATG GTAAAGCAAC ATGTAATGTT CCAATAATTG TGATTTCAAA

FIGURE 3MMMMMMMMM

751401 TCTAAAGTAC TATTTGTTCA TTCCCGAAAC CTGAAGCAAA CATCTGGTGG
751451 TTAATGCTTT AAGAAAAAAA GTACCTTAGT GCATTACCTC TGTATATGAT
751501 TCAAGATCAT GGGCAAAAAT ATGTAGATGA GATCAAGCCA CAAAAGTTTA
751551 AGTTGATCCA TTCAATTAAA AAAGGAAAAA GAAAAGATGG GCCGGGCGCG
751601 GTGGCTCACG CCTGTAATCC CAGCACTTTG GGAGGCCGAG GCGGGTGGAT
751651 CATGAGGTCA GGAGATCGAG ACCATCCTGG CTAACAAGGT GAAACCCCGT
751701 CTCTACTAAA AATACAAAAA ATTAGCCGGG CGCGGTGGCG GGCGCCTGTA
751751 GTCCCAGCTA CTCGGGAGGC TGAGGCAGGA GAATGGCGTG AACCCGGGAA
751801 GCGGAGCTTG CAGTGAGCCG AGATTGCGCC ACTGCAGTCC GCAGTCCGGC
751851 CCGGGCGACA GAGCGAGACT CCGTCTCAAA AAAAAAAAAA AAAAAAAAAA
751901 AGAAAAGACC CAGGTGCTTC TGTGTTTCCT CTAATGTAAG GAACGGAGAC
751951 TATGCAGTGC CTGAAGGACT TCTTCCTTTC TGCCTCATCT TGCAATTAGA
752001 TATAAACTGT ATCCCGTATA TATCCTCCCA TTGGAACAAA AGATGTGACT
752051 GCTTCCCTAT CCCTATTCCA TGTATGCTCA GAATTATTCC AGTTTGTGCA
752101 TACCATCAGG TTCATATTAT CATGCATTTT GTTAATTCAA ATTCTATTTC
752151 CTACATTAAA CTTATGTCCC ATTTTTTCTT GTTTTATTTT AAGATTTATT
752201 CCAGTTCATA CTTTCCATTT AAAGACAGCA GTTGTTGGCC AGGTGTGGTG
752251 GGCCTGTAAT CCCAGCACTT TGGGAGGCCA AGGTGGGTGG ATCACTTGAG
752301 GTCAGGAGTT CAATATGGAC CATCACCATG TTGGTCAGCC TGGCCGACAT
752351 GGTGAAACCC TGTCTCTACT AAAATACAAA AAAATTAGCT GGGCGTGGTG
752401 GCAGGTGACT GTAATCCCAG CTACTCGGGA GGCTGAGGCA GGAGAATTTC
752451 TTGAACCCAG GAGGCAGAAG TTGCTGTGAG CCAGGATCGC GCCATTGCAC
752501 TCCAGCCTGG GCAACAAGAG TGAAACTCCA TCTCAAAAAA AAAAAAAAAA
752551 AAAGACAACA GTTGAAATAA AATTGGAAAT AAAGTTGCAC TGTCCATTTT
752601 GTAATGTTGT TCATTTTAAC AAAGTGTTTT GAAAAAAAAA ATTTTATAGT
752651 GGTAGTGTAT TAGTCTGCTA GGGCTGCCAT AACAAAACAC CACAGACTGG
752701 GTGGTTTAAA CAATAGGAAT TTATTTCTCA CAGTTCTAGA GGCTGGAAGT
752751 CCAAGATCAA GGTGCTGACA GCTTGGCTTC TCCTAAGGCC CCACTCTGTG
752801 GCTTACAGAT GGCTTCTTCT TGAGGATGGC CTCAAATGGC TTTTTCTCTG
752851 TGCCTGCATG CCTCTGATAC CTTTTCATCT TCTTATAAGG AAAGAACAAA
752901 GTCATATTAG ATGAGGGCCA TACCCTTATA ATTTTATTTG ACCTTAATTA
752951 CTTCTTTAAA GACCCTATCT CAAAATATAG TCACAGTGGG GGTTAAGGCT
753001 TCAATGTATG AATTTTAGGG GAACACAATT GAGTTCATAA CAGGGAGCAA
753051 TGCCATTAAT CAAATATTCT GTAATACCTT CCCCTTACAG AAAAAAATAA
753101 AACCGTATGA AGGAAAGTGA TAACGTTGTC ACTTATATGT GATATCAAAT
753151 TATTCAAAAT ATAAATTTAT ATGTGAATAA TTTATATGAA ATATCATTTA
753201 TAGGTGAATG AGTAAATGAA CATAAAATAA CCATTAACTC TGCTTTTTGA
753251 CCTATCTTAA TAGAACCCAC AAAGATTTAG CAAAGGAACA GCCAGGCAGG
753301 CTAGCAAGTC ACACTCTTAC ATATTGTTTT CTGGAACAAA GAAAGATCCA
753351 GCATGAGAAA TGCCAGATGG GACTGCTGCC CTTGCCCTTG TATATGTTCT
753401 CGGGTCAAAT TGACAAATTT GGACTTTGTT CTCTGGAAAT GTGGCTTCCA
753451 TATTGGAAAC AAACCTGAAT CTTACTTAAA TAGCTCAATA TGCAGAGCCA
753501 CAAGACTGAG GCACTTTAGT CACAAACATA CAATAAAACA AGAATACTCT
753551 AGTATTGGTG CACAAATACA AGTAGAGGTA TCCTTACCCC CTTGTGAAGA
753601 TCACACCCAT TTTTTAGAAC ATGACTTTAT GTCCAATTGG ATCACTTGCA
753651 GTGTTCTCAT TTCTGAATTT TTTTAGTGCT TTGGATTAGG GTAGATAGAT
753701 TTAGTAAATA AAAATATAGA GTGCCCAGTT AAGTTTGAAT TGCAGATAAA
753751 CAATGATTTG GTTTTTTTTA AGTATAAATA TGTCTCATAT AATATTTGGG
753801 ATGTACTTAT ACCAAAAAAT TCCCTTGTGG AACATACTTA TAATGAAAAA
753851 TTATTTGTTA TTTAACTGAA ATACAAATTT AACCATGAGT CCCTTATTTT
753901 ATCTGGCTAC CCTACTTTGG GTTCAAGAAT GAATTTTCTC CCCTTGCAAC
753951 TCCCTGCCCC CCAACACTCT TAAGCTACTG TCACCAACTT TGTAAATTTA
754001 ATTCCCTAGT CTTAATTTGG TGCTGCCTTT AACCTCTGCC CCAATGCATG
754051 AAAACCTCGG GCTTCAGGCT TCCTTCTATT GGGCTGCTTT GATATGTGGT
754101 TACAGAATCC CTGTGCTTAA GTATTACATC TTTACATCAT ATGACAGCAT
754151 TAATATACAT AAGGTACTCA ATAATATGGT GAGAAATTTC TAAACCTTGA
754201 AATTTCCAAG CCCTGGGCTC AGTTTGCTCA CTTATAAAAT CAAGGGAGTG
754251 GATTCAAGGT GTTTTCCCCA AGGTTTCTTC TAACAATTCC ATGCTACTAG
754301 TCTTTGAAAT GAGTGTTCCA TTAATGCTCT CATTTGCCTT GTAAAACCTA
754351 AATTGTTCCC ATTTTGGATG AATCCCGCCC CGACCCCCCT ATACAGAGAG
754401 CAAGAGAAGT AACGTAGGCA AGCGACGCGA CTAACGGAAG TGTTCCCCCC
754451 CGCGCCACTA GTTCGAAGCA CCCGATTGAG CACGCGCCCG ACGGGACTAT
754501 AGAGACGCCG ACCCGCGGAG CGTGCCCGTC CCATCAGACG GCTCCCNNNN
754551 NNNNNNNNNN NNNNNNNNNN NNNNNNNNNN NNNNNNNNNN NNNNNNTTGT
754601 ATATACATTT GTAATTTGTC CCTTTTCTAA CGAATGTTTG GGTGATTTAA
754651 GGGGGAAGTA ATGAGTAGTA ATGAGGAACA ATGTTAGAGA GAGTATGAAG
754701 TAGCGTGGAG GAATAAAGAG GAGGAAGGGC GGCTAAGAAT GTAGTGCTGT
754751 AGGTTAGTTA GGAGGTTGCG GTTATAATAA TCAAGTTGTA AGAGGGTCAA

FIGURE 3NNNNNNNNNN

754801 TTCTGTAGGT ACGCTGAATC ATGTTGGTGA GGAAGGGAGA GATGCCCCCC
754851 CCCACCCCCC CCGCCGCGGT AAGTAGTGTT TAGATTACTC AATTAATAGT
754901 TTCACCTTTA AAGATATTTA ACTTAAATTC CTTAAGGGCC AAAGAACACA
754951 CTTTTCTTTC CACCCCTACT TGCACCAGGC TTTGCACACA GTGGGTGATC
755001 AGATTATGTG ATCATGATCA TGGACAATGT TGAAACAATC CCTTTGTGGT
755051 GAGCTCTGAC TGTCAAAAAT AATTTTTGTT ATGAACCTAA GCCACCTCCA
755101 CGGTTTAAGA CAGCAATCTG GGAGCCGCTC ATTGTTCTCT TCCGCCATCT
755151 AGTGGCGCTA GGGCTGCTTT CGTCCCTTCA ACTCGCACTT TGGAGCTGCA
755201 GGGATTTTAA AATTGTAAAT CAAATGGATG AATTGTTTTA TTCTTGTCAT
755251 TACAGTAAAA AGGGATTTAT AGAGTGTTTC AAGAGATAAA AGGTAATAAA
755301 TGTTAATAAA ATTTAAGTGT AATACAATGG CAGACTTTAA TTCTTGAACC
755351 TTTAAATTCA TACAATTTAA TTCCTTTAAT ATGTTAAAAT GTTAAGTTGA
755401 AATTGAAGAA TAAAAATATA AACTATATTA AAGTTTTTGA AAGAAAGATT
755451 ATCCTTTCAA GGTGCGCTTA TATACTGGTT AAGAATGTTT TCATATAAAA
755501 TAAATGTAAT CATAGCAGAT GTAAAGCAAA CAAAGGGAAC AAATAAAATT
755551 CTGGTAAGTA TTGAATTGGT AGAGAATGTT TCCGTTCTGT ATTTAAGCAC
755601 TTGTCTTCAA TTAAGTTAGA GATTATTCTC ATTATTATTT ATAAATGCAA
755651 TACAATGTTT AATGAGTGTT GAACGATATT TAGTTTTAAT GTCCTATAAT
755701 CTGGAACTTT CTTCAAATGG CATTATAGAG GGGTTAATTG TGTGAATCTA
755751 AAGTAAAAAT AAATTTCTCT AATGAATGAA ATAAAATATT TCTGAAGTGT
755801 GACTTATTTC CCATTAAAGC TATTTTTACT GAATAATTAT AGGAAATGTT
755851 TCTGACATTT TAACATTATT CTGGCTTTCT TTTGATTTTA ATTTAAAATG
755901 CCAGTGCTAT TATGAAGTAT TTAGATCTTT CTAATAAAAA ATATTTAATT
755951 GGAATACCAT TTTGTTTTTA ATACAACGAT AAGCCAGCTA AGAAATCTCC
756001 AATTTGTTTT CCAGGGTGGA AAAATCCCCA TAAGGTGGAC AGCCCCAGAA
756051 GCCATCGCCT ACAGAAAATT CTCCTCAGCA AGCGATGCAT GGAGCTATGG
756101 CATTGTCATG TGGGAGGTCA TGTCCTATGG AGAGAGACCT TATTGGGAAA
756151 TGTCTAACCA AGATGTAAGT GCTACCGATA GTTAAACTGC CATTTTGTGA
756201 ATGTAAACAC ATTAGCTTGA GGGGGAATTA TGCCTTTTGT CCTCACTCAG
756251 ATTGGCCTTT ATCTTCCTGA GAACTTCTCA TGGTCTATGG CTGAGTTTGA
756301 GAAGCTGAGT AACCTTTCAC TCTGAGCTGT ATTTGATGTC CTCAGGGACA
756351 GCTGCCAGGC TGTGCCATGT GAGTGCCTGA TGCACATGTT ACATCTCAGA
756401 TTTCCATGCT TGTTCTAATG AAGTCTGACT GTGTTTGTGC AATAGCCTTG
756451 ACCTACAAGT AAGACAAAAG AAAGAGTAAT GTTTACTTTT CGTTTCTTCC
756501 TTAGGGCAAT TCAATGCAGC ACTGTAAAGA GCAAATCAAT TTAGACTAGA
756551 TATCACTTAG AGGGAAAAAA GTGAATGCTT TCAGGCAATG CATTATCAAT
756601 ATGTGCCATC TAGTACGGTT CTTTTGATAT GCATGACCCC TAATGCAAAC
756651 TGTTTTGTTT CTATTTTATC TATAAAACTA CCTTGGTGGT TGATACTATA
756701 ATATTATAGA ACAGGAGAAT TCACACATTG AACCCCTGTG ACCTATCCAC
756751 AGTGATAGAG ACAGTATTCA GAAGATGCAG ATACTCTGAC AATGCAAATA
756801 AGTGTGCTGT CAGAGCTGAC ATTATATTTT AAGTTCCCAC TTCCTCATCT
756851 CGAAATTCAG GCTTTGTCTA CTCACCTGTT CTTCTCAAAC TATAAGATGG
756901 TTTCTGATAC AATGGTAATA AGAAATCACC TATAATGTGA TTCTGAATGT
756951 TCATAGGTGA AAACAAAGGC TACGTAACTA TAGATAATCC CTAAACACTA
757001 TTGCCACATC TCATTTATTT TTGCCAGTTT TAACACAACT TAAGCAACCC
757051 ACACACACCT CCACACCTCA TACTATCCCA ATCTCAAGTT GTCCAAGTAT
757101 CTTAAGGACT TAATCACAGA GAAAATTTAT CCTTTTCTAA TGTCAGGCAT
757151 AGATAAGATT GGATTTTGGT TGGCTGGCAA TGGCTAGTGT TTCTCCCTGC
757201 CATACAGTAC TGCTTTTGAA GCTGACTCCT TAGTACTGTG GGTGTCTACT
757251 GACTCTGTGG AAAATGCTAG GTCCAGAAGT TAACGTAGCA GCAGGTTTGA
757301 GGCCAAACAC ACTGCTCAGT CATTGTTCTC CAAAGCACAA CATCAAACTG
757351 CAAAGCCAGT GTGGCTGGGC CCTACAGAGC ATTTGGCCTT AAGGACAAAG
757401 TGCATCGTAA CCAGCAACCT TTGCTCCACC CCCGCAACAC TTAGACTTTT
757451 TGGATCTGGG CCATTTGCCT ACAGTCTGCT ATTCATCAGG GAATCATATT
757501 TGAAGGACTC CTTTGCTCTT CCCTGCCATT GGGCTTTGTT TGGGGCAGTT
757551 CCTGGCTGCT TTTCCAGTTT TTCCTAAAAC TGAATTCCAG AGGCATAAAT
757601 TTGTTCCTTC ACTTTCAAAA GGAACCCATA TTTGGGGATT TTGTTTGTTT
757651 GTTTGTTTTA ACCAGTTACC TTAGGTAGTA AAAGCCCTGG TTTCAGTCAC
757701 CATAATTCCT CTTCTGCCCT AAACTCAAGA TAATGCTTGC CTGCTTGTCC
757751 TATTTTAACA CAACCAAAAT AGGCCATTCA AGCAAATGCC CAGAATAAAA
757801 AGTCCTTCTC CTCCAGATGA GTTATAGTCT TCACTGCACA GAAGAGTCTT
757851 CAAGTACCCT CCCTAATTGG TATTCTATTT GGTTCTTGTC TTAACCAGTT
757901 CCCAGCAGAC TTAAATCAGA GGGCCCAAAA CTTTACTAAT ATACTGGTAT
757951 CAGTAAGAAG TTCTTGAGCA TCCATAGATG GCATATGTAT ATTTATTTGC
758001 AGATTATATA CAAGTACTAC TGTACTAATA TATTCATTTA AAACTATTTA
758051 GTGAATGCCT TCTCCATTCT AGGAACTAGG CTTTCACCAG AGAACACATA
758101 TTACATTTGG AAGGGACTGT AAAGATTATA CTAGGCCAAT CCCTTTATTG
758151 GTCATGAAAC TGAGGCATAG AGAAGTGACA TATTTCCTTA AACTCTCATA

FIGURE 3OOOOOOOO

758201 GTGGTGACTT ATTAATGCTC TTAGAAAATA ATTCCAATAA ACTTCTAGAC
758251 TAGGTCATGG GCAAGGAGAA GAGGAATAAT TGTATCTTTC ATGGTGGTTT
758301 TGTTTACAGT CCATGTAGCT CCTCACGTAG GGCCAGTGGT TTCTTGCCCT
758351 CATGGAGCTT ACTTTCTAAT GGGAGGGAGA TAGACTATAA ACAAAATCGA
758401 TAAGAGACAT AGTATATAAC ATGATAATCA CTGCTATGGG GGAAAAAAGC
758451 AAGAGAAGAG GATAAGAGAT ATTGGGTTGT TGATTTAAAT ATATATATAT
758501 ATTGCAAAAT ATATTCATAA AAGTCATTTA TGGTCATAAA AGTAATAATC
758551 ATTCTAATTA GACATTCATA AATAATCATT CTTATAATAG GAGGATACAA
758601 ATAAATATAA AAAGCAGTTC CATGATTTTT CCTGCCCCCC AGATTATGGC
758651 ACCACCCATT TAGTAACCAT GGCCACAGTT ATGTGGACTA TAACTCAACC
758701 ATGAAAGACA CTTAACTTTA AAAGTGCCTC ACTTTCAATA AGTACAAGAA
758751 AGGGGTGAGA TGATTTTTAA TATCCACTTT AACAGTAACA TGCTATGATT
758801 TTATAATCTC TGAAGAAATA TTTATTATAT TTTTCTCAGC AAATGGAATA
758851 AGGAATGATT CATAATATTC TTTTCTGATG TTTAGGACTT TTCTGAATCT
758901 CTGCAGAGGT GCCAAGAATT AGATAGGATG TCCACAGAGC AGAAGGACAA
758951 ATGAAGATGC CAGACCACAA GACAGATTTT TTAGGAGAGC AGCTTTTGCC
759001 CAAATGTGTA GTTTTCAACA TAGTCCACCA TGTAAATTGT TCTTAATAAT
759051 TGTAGCCTAA AGCAGTCCAA ACCCTGTTGT CCATCATCTT TTCCTGGATC
759101 TTGCCCAAAA GGTTGCCCAG CCATTCTGGC CATGTATATT GGTGATCTGT
759151 GTCCAAGACG ACCATTTAGA GAGTGATTTT TGTCTATTAA ACCTCATTTG
759201 GCCACAGAGG CTCTATCTGG AACCTGGAGA AGATGCTGCA GCCAGGAATA
759251 GAGTTCCAAC ATTAAGCTCA TTCTCATTCG TTCAGGATTG CCAATGCTCA
759301 CAGCACAAGG CTGAACTCTT CCTCCACCCA GAGCTTGATT GTTTTTCCAC
759351 TAGGTAGGGT TTAAGCTGTT GTATTGTCAT GGTCTTGACG TGCATTACCA
759401 AAGAATATTC AAGCAAGAAT CTGGGAAAAG GGGAAAAAAG AGGATGGAGG
759451 CCTGGGGGGT GAAAAAAAAC CCAAACCTTG AGGTCCTCAC ATCAATTCAA
759501 GACTACAGGA AAATAGTAGG AGCTAAAATC TTTTATGTAT CTTGTGAATA
759551 TTTTTGCTGC TGCAGTAAAG AGAGTTGAAA TTCTGTTTAG CTTCACATAT
759601 TGGAAGTCAG CATAACTGTG ACAGATCCTA TAACCAGGAT TTTGTTTGGA
759651 AGCAGAAATA GCTTAATCAA AAACTTCCCA GCTGCTCTTT CCAAATACTG
759701 GCTATTCCCT ATCTGTCCTG CATTTCTCAT TTATTTGATC AAAATACAGT
759751 ATTACATTTG ACTTTTACCA AGCAAGGCCT CTTTTAAATG AAAATGTGAT
759801 AGACAATACA AATTTGACTA TGTTCTGTGA GAATATTTTA TATTTTTACT
759851 ACAATTTGGT GAGTTTAACA AGGCTATTCA TACAGATCAA ATGGAATGTT
759901 ACCATGTTTT ATGATTTTAA ATTAGTTTAA GAAATTTCAG ATTGTTTTTA
759951 TGAGTTTCTC CGTTCTGCAG ACTGTTGTAT ATTTTATTAC AATGAACAAT
760001 TCTGAATCTG CAGAATCTGT TTTAGTGAAT AATATAATGA GTTTCCCAAA
760051 GGTCAGTGGT ATTATACTTT AGGGAAAGGA AATGAGAAAA AAAGAGTACA
760101 CAGAACTAGT CCATAAAAGA CCTAACAAAA TATAATAGCA GGTACCATCT
760151 GCTTAGCCAT TCAGCAGTTA AGCATGCGCC AGTCATTAGA CCAAATGTGT
760201 ATGTGGGGTG GGGATGGGGA ATTAGAAAAT CCAGTTCTCA GTAGGCCAAG
760251 CATAGTAGCT CACACATATA ATCAATGCTT TGGGAGGCTG AGGCAGGAAG
760301 ATCACTTCCC AGGAGTTCCA GACCAATGTG GGGAATATAG CGAGACCTTG
760351 TCTCTACAAA ATATAGAAAA AATTAGCTGG GTGTGGTGGC GCACACCTAC
760401 AGTCACAGTT ACTCAGAAGG CTTGAGCCCA AGAGTTCCAG GTGACAGTGA
760451 GCCATGATGA TGTGTCACTG TACTCCAGCC TGGTGACAGA GTGAAGTCCG
760501 GTATCTTTTT TTTTTAAGGG AAATAAAGTA AAAGAAAATG CAGTTTTCAC
760551 TCTCAAAGAA CCCACTATGT AGGTAATGAG ATAAAATTCT GGTATTTTTA
760601 AGTGTTATCC CCACCCCCAA ATAGAATGTA GACTCATCAA GGGTAGATTC
760651 TGTGCCTTCT ACTTGTTTTT TAAATGGAAA CAATACTGTG TGAAAACACA
760701 GTTATTGTTT AATAAATATA TATGCCAAGA AAGCTTGCAG ACCCTATTTT
760751 TCAGGGTTCT TTTGATTACA AATGAAAGAA ATGTAACCCA AAGTAACATA
760801 AGCAAAAATT AGGAAATTTT TTCATCATGA AACTAAGAAG GTGGTCCAGC
760851 ATTGCTCAAT CCAGAGGCTC GTGCAGGATT TTTAGTGCTT CACTAGGTGC
760901 ATTGACCTCA TTCTCTCCTA CTGCTAAGTT CTTCGCTGTC TGCTTCTTTA
760951 CATTCCAGGG CTCAGTATTC CAGCTTTGCA ACCCCAGCAA AACGAGACCT
761001 TCTTTCTGTG CAAATTCGTA CACAAATCCC AGAGGAGATT CTGGCTGGCT
761051 TTGTTAGGAC CTTGCCCAAC ACTAAACAAA AACCATGCCA GGGAAATGGA
761101 CACTATGATT GACCCAGCTA GGTTTATATG CCAGTCTGTG CACTTAGAGG
761151 TGGTCAGAGC ATTGTAACTG GCAGTTTCCC CATAATTACC TCGAGTGAGG
761201 GAGGAATTCC CCAAAGCAAT GCAGTTGTGC TATCAGAAGG TGTATATTAC
761251 TTTTTTGGTA TATATCGTTT TCAAGAGCAA CTTTATTTAC TGCAGTATCA
761301 AATAACAGCA AAATATTAAC ATTGTGCATC ACTGTATTCT AATGAGGCAG
761351 CAGATGTTAT TGAAAAGACC AGTCGGGCTT TAGAACAAGA TCTCTCAACC
761401 TTAGCACTAT TGACATTTGG GGCCAAAAAA TTCTTTGCAG ATAAATATGT
761451 TACATGCTTT GCAGCACATT CAGCAGCATA CTCAGCCACT AAGAAGCAGA
761501 TGCCAGTAAA ACCCTCCCAC ACTGTGACAA CCAAAAATAT CCCAGATGTT
761551 GTCCCGTCAT CAACATAAGA TGGAGGGGAA AATCACCCCC AGTTAAGAGC

FIGURE 3PPPPPPPPP

761601 CACCGCTTTC TAGCTAGAAA GATCTGGGAT CGAATCCCAG ATCCACAATT
761651 CACTAGCCAT ATAATCTTAG GCAAGTTGTT TAAGCTTTCT GAGATACTGG
761701 GTATACTGAG GTTCAAAATA CCCAGCTCTG GAATTTGAAA GAATTAGAGA
761751 TAATATATGT AAAGTACCTG GTACATAGGT GTTTAATCAA TGGTAATAAT
761801 AGCTTACATT TTCTGGTCTT ACTATGAGCC AAGTATTTTA TATTATTAGC
761851 TCATTTAATT TTCAAGATTA TTTTCTGTTG TAGGTAACCA TTATTATTCC
761901 CATTTCTAGA TAAGATAACT GAGGCTTATA AAGTACAAGT AGCTTACCCA
761951 TGGTTACATA GCTGGTTACT GATAACACCA AAGTTCAGGC CCCCTGCTTA
762001 CTCCTAAATG CATGCTTTTA CCCGTTAAGC TCTACTGTGG AAGTCCAATT
762051 TTCAAAGGAG TCTTCACACC ACAGTTCTAC AAAATGAGAT CAAAGCACAT
762101 TTAATTATGC ATGCTCCTCT ATCACAAGAG TAGTATTTTT ATTGTTTCCT
762151 ATTCGCAAAA TAATGTGGAT TGACTCCCAG TTGTTTGGAA ATATAAATAT
762201 TTTCTGCAGG ATTTTTGTCT TGATGTTAAA AATTTATAAA ATGTACCATA
762251 CCGTTACTAT ATTTCTTAAA AATATTTAAG GCAGTAGCTT AAAATCAAAT
762301 TTTAAAGATT GACATATTTA GCCTATTGCC AGAAACATTT CACAAGTACC
762351 TTGAAAGTGT ATAGCCCCTT GCTGTTTTCC AGCGTATGAA GATTTTTATT
762401 CTTTTTTATA AGGTATTTCA GGGTAATGTT TTATGTTATT TTCATCCAAG
762451 TTCAAAATAG TTATTATTTA CTACATAATG GAAGTGCATT GTAATGCTGG
762501 AACTACACAT GCTCCAAAGA TGATACCAAG GGCACTGTGG TTCTTCCCTC
762551 CAACACTTAT ACCATGTAAT GTAGTTAACA GAAGAAAATG GAAGCAAAAC
762601 ACGAACAGCA GGCAACATTA AATAACCAAA TCCCCACAGA GCTCATATGT
762651 GGGGAAAAAA GTAGCGACAC TTAAATGAGA GGTGACTTAG CTCAAGCTAA
762701 TGATCTAAAT GTAAGATTGC AGTCTTGGGT TTTGTTTTGT TTTGTTTCTT
762751 TCCCCTGACA TGATGCTGTT AAAAAATAAA AATCACCTTG AAGCACTTTG
762801 AAGCCCAAAT GCCTCCTGGG TATGGTATCA TTTAGGCATA TGCTAGCTAG
762851 CTAACTAGTT CAGTTTCCCA AAAAGAGAAC TGCTATCAGG GAGCATTTCA
762901 TTTGAGGTTT ACTAGAAAAC AGGATGCTTC CTTGGTGTTT TTGTTTTCAT
762951 TTATTTTTCC CTCCTTGCTT TTCAAATGCT TTTAAATAAT AATGAGTTTT
763001 GCTTTAGATT GTTTTCTGAA ACTCACCTGA GGGGGAAAAT ATGGAGTTTA
763051 TCATTAGAAT TTTATTTTTA TAGGTGATGT GGTCAGAAAC AAACTTTTGA
763101 TCTTAGCTGA ATTGATTTGT TTTTTCCAAA TTTAAGAAGG AAGAAAATAA
763151 CCTTTTACTG TACTTCCTGT TTGTCCTCAT AATTCTATAA CCTTTCTCAA
763201 TTATGGGTCA GTCTTTCAGC CAAGAATAGT GGATATGTAG AATCCACTTA
763251 CCTGAAATGC AGCATGATTT TATGACTCAG AGATCCCAGT CATTTCCAAT
763301 TTTTGTCTCT GATTAGATTT TCCAAACTCT ACTTTATTAT GTAATGGTCC
763351 TTGTGTAATG ATCTGTGTAA GACACTACAG CAAATTGCTA AAAGCCCATT
763401 TCTATTATTT CAACCTTCCA TAATACAGAG GAATTTTTAC ATTTATTTGA
763451 ATATGTATTC TACCAAAGGA ATTTTCAAAA AGGCCTTCGT TTTCCTAACT
763501 TTTCAGTAAT TCTTACTGTT GGTAAATAGG CTATCGCAGT ATTTTAATTA
763551 AATACATACT AATTACATGA GTATGATGTA CATCTGCTAC AGAGGCAAGA
763601 ATAATAGGGA ATATTACAAG ATGTAATCAA TCATAATTCA AATAAGTTTC
763651 AAGGAGAAGA AACCAGTAAA CAATACAGTA CTACCACAGT ATAACTTTTA
763701 AGGGAAAATT TTTTTAACTG AATGACCACA AAACTGGAAA ATGTGTACAT
763751 GCCAGCAATA TTTTCATAAA AAATTAATTA TACCTTTAAT TTCTATTTGG
763801 AAGAAATATA TTTACTAGCT TTAGAACTTA CTTATGATTT TTATTCATTT
763851 TCATGCTCTT TGGAGCCTTT ACAAAGAGAG CATTTTCAAA TTCCCTTTTT
763901 CTTTGTAGTC ATAATCTATT TTTCCATAGC TTTTAGATAT TTTTAGTGGA
763951 GCCAGGAAAT GTATTATTTA GAGTTGTCTA CTATCTTTCT AAAATCAAAA
764001 TGATCCACCA GTGAAGAAAT CTCATTTTTT TCCCAGAGAG TGCTTGGGAA
764051 ATGGCACTAA GTCTTAAGAA CATCAGCTTC TTAAAGAAAA AAAAATAGTC
764101 TCAGAAAAGT AGATTTGGAA TGTGTCCTTG TATTTTCAAA AATGTAATTT
764151 GTTGTCCAGG AACTGGCATA GTAAGAAATA CCATGGTGCC CCAAATCTTC
764201 CTAGCTATAC TTTACAAGGA TATACTCTGG TTCTGTCTGT ATTTTTGTCT
764251 CAGTATAGAG GTCCACCTAA GCACTTGGAA CTCTGTGAGA AATATTCCTT
764301 AGAATGGAGG CCAAATCCAG AATTAAATTT ACAGAAACTC CAGATCTAGA
764351 GATGTTACCA AAGTTCCTAC AGACTAAATC TTTGGTTTCA ATGACCAGAA
764401 TCATAGATTT TTTGAGGTGA AAGGTACTAT TGCAGACAGA GTCCAGTCCT
764451 CTTTCCTTTA TCAGTGAAGA GTCAGAGACT TGCCCAAAGG CAGAGCTTGG
764501 TTAGTGACAA CTTAGGACTT CAGTGCGGTT TCAGGCAACT CCTTCTCTAA
764551 TGTTGTTTCC ATGACTTACA AACTGAATGA GACTTTAAAC TGTTAGCAAC
764601 AAAGATTTTT TAAATGATAA ATCATGTCAT CAACAACTTT TTAACATATG
764651 AGAGTCCTAC ATGTTGTTCC TCATTTTGTC CACTCATTTA ACAATCCGTA
764701 AAAAGGAGAC CTCCTGAAGG ACCAACATTT TCTATTTTAT ATAGGTCCTT
764751 GACATGCTAT TGTGACTTCC AAAAAGAAAG GATGGAGAAT TGTCTTAGGT
764801 GTAGGATTTT AAGAAAGTTT TTTTTTAATC TTAAAGCTAA GAAGAAAATC
764851 TTAAAAAGAA AATCTTAGGC TAAATAACAA ATTAGTCTCT GAAAAAAGTG
764901 TTTTCTCTGT CTAAATATTT CATCACTGTA ACGCCTTTTT TCTATAATTC
764951 TTTTTATTAG TATACCTAAT TTCATTTGGC ATTTGATTGC TTTTAATTGA

FIGURE 3QQQQQQQQ

```
765001 GTTATACATT CTGAATGTTG AAAAATATTG AATGAGAAAG TATATTAGTC
765051 CATTTTCACA CTGCTATGAA GAAATAACCA GAGACTGGGT AATTTATAAA
765101 GGAAAAAGGC TTAATGGACT CACAGTTCCT CATGGCTGGG GAGGCCTCAC
765151 AATCATGGTA GAAGACAAAA AGGAGTGAAG GCATGTCTTA CGTGGTGGCA
765201 GGCAAGAGAA TATGTGCAGG GGGACTGCCC TTTGTAAAAC CATCAGATCT
765251 CATGGGACTT ATTCACGATC ACGAGAACAG CACGGGAAAG ACACACCCCC
765301 ATGATTCAAT TACCTGCCAC TGGGTTCCTC CCACGACATG TGGGGATTGT
765351 CGGAGCTACA GTACAAGATG AGATTTGGGT GGGGACACGG CCAAGCCATA
765401 TCAGAAAGTA TAAAATTACA AGTGTTATTT ACTTAGAACC ACTTTCCTTC
765451 TGCCTTGTTT TTTCTTTTTC TTTTTTTTTT GCTCATGTAG ACACAATCTT
765501 TATATTGCAC ACCAGGAAAA TACATTACCA GTGTTTTCAG TGTTATTGTA
765551 TTATGAATAT AAATATCCTA ATCTGTATAA ATAATCGTTA CCACAAAAAG
765601 TAAGTATAGA CTGTGACTCT CTGCTTTGCA ATCCCCCTTC TACCTGAAAT
765651 TATAGGTTTT CCACAAAGAT GTGAAGAATA TTTAGAAGGA AGATAAAAAT
765701 AAAATCATTT CACATTCCAT TTTCTAGTGT ACATTTCAGC CCTTGTTAAA
765751 TTTTGAGACA GTTTCTTTTT AAAAGACTGT ATAAATAACT AAATTCAACG
765801 TGCCTCTCTT TTGGAGATAC CTAGCAGCCT TATAACATAA AAATGTGATA
765851 CCCTGCAGAG TCTAAGCAGT CCTTGCTCAA TAGTATTGTT CAGAGATGTC
765901 TCAATATCTT CTTATTGACT GTCTAATACT TGTTTTCCTT AATATAAGAT
765951 GTGCATTGCC TTCTTTGATT CAGAAACCAT CAAGAAAATT GGAAAACTCA
766001 TCAGATTCAG CAAGAGCAGA ACAGCCTGCT ACGTGCCCCA ACTGAGCCTT
766051 CTGTTGATTC TAGGTTGTTA AAAATTGTGA TGTCAATGTC AAGAAACCAG
766101 TATGATCTAT TTAGAATAAG CAGCCAGGTT TAAGATAATA ATTTCTGACA
766151 GAATGTAATT CCTTCTAACT TTTCATAAAA ATTATCATTG CAGTCATTTT
766201 CATATTTTTC ACATTATTTT AATTTTCTTC TTACATTATA ACCTTGTATA
766251 ACTCTTCTTC CAAAGGATGA CAGCCTACAA ATATCATAAA ACCAAACTGT
766301 TAAAAAATTC TCTCTAGTTA ATTATCACCC CTTCGTATCC TAAGACAACA
766351 AACCTCAATT AGTCCTTTAG ACAAAGCACC CCATATGCTG CTCCCTGTCA
766401 GTCCTTAATT AGGGAATCAG AATATACCTC TAAGTCAAAA CTTTCCACAA
766451 AGAAAATGTT TATGAAGATA AAGGTTAATA TAGGATTTCT CAAGCTTCTC
766501 TGAAAATTCA GCTTTCATAA ATCACATATC TGACAATTGG CACTCCATTC
766551 TTTGACTTGA CAAGGCATTG TGCTACATGC TGGGAACACG TGGAACAAAG
766601 AAACAGTCGC TGCTCTGGAG GAGCTCAGTT CACCCAAGCT AAGAGACTAC
766651 AAATGTTTTG TATTGGCTGG AGCCAAGGGT AAAACGGAAC ACAGCAAAGG
766701 TGAGGACTGA GAGCCAGGCA CATGGTGAGC CATTGCAGAA TTTCAGATGT
766751 GGGAGGAACA TGATCACAGT TCCACTTCAG TAGGATTGCT TTCATTGCAT
766801 CGTGGGGGAT GATTGGTGGA GGAAAAGGAG AAGCAAGGAG ACTAATGGGG
766851 GGCCTTTGCA GTGATCAAAA TGGGAAATAA ATCATTTGAA GACAGAATGA
766901 AAAAAGATTT AAATTTTATG AAGGCGGTAG AATCAGCATG ATGAGTTAAT
766951 TTTGAGCAAC AGGAAAGGCA GAGGCCCAGA TGACTCCCTG ACCGCTAACT
767001 TGAATCACTG GAAGAATGGC AGTACCCTTC CTAAAGGACA AAAATCCCAA
767051 AGGAGGAGCG GGTTTAGTTT TGCACAAAAG AAATCCAAGA TACCTTTATG
767101 AAGTGATATA TCCTATAGGT GATAAATATA GAAATCTGGA GAGAAAGCTG
767151 AGCTAGAGCT GCAGACATGG AGGCCATAAG CAGATAGGTG ATAGTGAAAG
767201 CACGGAGTAT ATAAGTCACA CAAAGAGATC TCAAGATCTA ATTCTGGGGG
767251 AATGCGTCAA GATGTGGTGC AAGTCTCAGG ACAGATTTCT CTACCATTAC
767301 TGTGATCGAG AGGCTACCAT GATGATAATA TTAATCTATT ATTCATGAAA
767351 CTACTTGCTA TGTGATATTG ACCCAATCTT TTAATCAGTT TGAGGTTTGG
767401 TTTTCTTACC TATGTGTATA ATCATACTCA AATAATAAAG TATTTTGAGA
767451 CCTAAATTAG GTAAACTGTG TTAAAACACC TAGCTCAGAA CTTGACACAT
767501 AATAAACTCT CAAAGGTATA TATGTTGAAT CTGAAACCAG AAAGTTGATA
767551 GAAAATTGAA CTCATCATCA CTCCAACCCG AGAATTGCTT CTTCTCCTCT
767601 GTCCTCTCTC TTTACCAGCT GACGAAGCCA AAATCCTAGA AGTTGTTTAT
767651 CTCCTCCCTC TACTTGGCAC ATCTAATCTC AGCCCAGTCC TGTCAAAACA
767701 GTTCACTTCT TGAACACCAC AGCCATTGCC TCCACTAAGG CCTGGACCAC
767751 TGCAAAGCTC CTTCCTGGAT CCTTTGACTC CCCAGTGCAC TCTCCGCACT
767801 GCAGCCACAG TGAGCTTTTC TAAATGGGAA ATCTAATATA ATTTACTTTC
767851 TAAAATCCTT TTCCCCTTTG CATAAAATCT AAGTTTATAT CATGCCAAAT
767901 CATTCGTGAT CTCAAGAAAC ATAATTTTAC GTAACCTCCC AACCTCAAAA
767951 CTCACCATTC CTCTCTTTGA AGACTATTCT AGCCACCTAA ATCTACTTGC
768001 ATTCTAGATC ACATCTCCTT TCCTCAACCC ACGCACTTGG CCCTGCACCC
768051 TTTCACATAC CCCTTAAGGT TCAGTCACCT CCTGGAAGAA GCCTTCCTGA
768101 GGCTGGGTTA GGTACCTCTC CCACATGCTC CCATAACAGC CTGTTCTATG
768151 TGGCACTTCC CATATTCATA GTCCCTGGTC ATTCTCAATA GTTAATACGT
768201 TTCTTAAAGA CAGAGATATA CCTGACTTGT TATGTTATCC CTTGAACACA
768251 GAATGGTCAA TAGTACATAT TAAGTGTTTA ATATCTATCC GTTTGGATGA
768301 ATAAATTTAA AAATCTGTTA GAAACATATA TCTTTTAAGC AATTTTGTGA
768351 ATTGCTTAAA AAATATAAGT TTCTTCTTTG ACTACCTTTG AAGACAATTT
```

FIGURE 3RRRRRRRRR

768401 TCAGATGTGT GATCTTGGGC AGGTTAAACC TCTTGTTATG ATTATTTGTC
768451 TGTAAAATGG AGATAACAAT TATACCTACC TCATAAAGTT ATTGTGAAGA
768501 TTAAAAGAGT TAACACATGA ACATCGCTTA GAACTGGCCT TGAAAGTACT
768551 CAAGAGCTCT CAATAATTGC TAATAATCTG TTTTTATCAC TGTCACTCTT
768601 GCTGTTATTG TTACTCTTTT CCTGTAAGAT GGGTCCCTTT GTGTTTGGCA
768651 CCTGTCCCTG GCTCAAGACA GATTTCGCAA GGCTGTAAAT TAAAGAATTG
768701 AGGAAATTTA TAAGCCAGAG GTCAGCAAGA AAAAGTCATG AGTCTTCTGA
768751 TCCTCCCACT GTCCCCACAG AGAGGCCGGG ACCACATGCT CTACTGGATG
768801 CATTGTGGGT AAAATTTCCA GGCAAGGGAA CCTACCCGCT CATCACTCTT
768851 ACAAGGCATG CATGAGAGCA ACTTTGTCAA GAGGCTTAAG CAACCTGCTT
768901 AATGCTAAGC ATTCTAGATT TGGATGCCAA CTGTCTACAG GAGTTGTCTG
768951 AAGCTAAGGA CCTGGGGCCA ATGGAAAATA ATAACCCTGT GGACAGGAGG
769001 CAGAAGCCAC AAGTCTTACA AGAAGCTGGG TTTTGGTCAA GTACCTACCT
769051 CTTAGAGAAG AGCAAGCTTC CAGTTTCATC TGGCTCCTTG TCCAGGAAAG
769101 CCAGAGTGAG TTTATGAGAT CATTTTTGGA CAAGGTTGCT TGATGCAGCA
769151 GTTTTTAAAT CAACACCTTC TTCAGAGAGG ACTTCAAATG CCATCATGCT
769201 TATACTTTGA ATCTATTTTT AATAGGTTGA GACACTAAGT TTTCCAAGAA
769251 TCTGCTCCTC TATCAAGACA AATCCAAAAA TTTCTTCTAA TAGCATTTGT
769301 TTAGGTCAAT AATATTTATT AATGTGTCAG GCAATGTACT AAACGATAAG
769351 CATAGAAAAT TTAGAAGTAT AATTCCTGCT TTCAGGTATG TACAGACTTA
769401 GAGGAAAGGC AGATGAAAAA ATTACAGTAC AATGTTATGG ATGCAATCAT
769451 ACATACATGC ACAAGACTCA GAGGCATTAA GAAATGACTC TGTTCAGTTT
769501 GAGATTATAT TGTGCAAACT ATGAAATAAA TAATTTTTAT TTACCCAGAA
769551 TATTAAACTT AGGATCCAAG TAAAAACATT GAAGTCCAAA TAGCAGATGC
769601 CATGACAAAA GATAGCATGG TAATCACTAC TAAAATTGTA CTGGGTGATA
769651 AGAAATTGGA GAGGAAGATG TTTTATCATG AGAACTAAAA AGCATTTCTG
769701 GGGAGTGGTC AGAGGAGAAT GTTGTAAGTT AAAAGGAATT TAGTTCAAAT
769751 TTCAACCCTG CCACTTACTA GCTATGTGAA TTTAGGCAAG TTTCCTTATT
769801 CCTCTGAGTC TAAATTGTCT CATTTAAGAA ATGGGGATAA TAATATCTAC
769851 CATATTGAGC TATTTTAAGC AGTAAATGAA TAAAAATATG CAAAGTGCAT
769901 AGCACATGGT AGATAATAAA GGAAGCTATT TCTTTCTAAG AATATAACCT
769951 CACTTGTCAC CTATTTTATT CCATGCGTTT ATAATTAGAT AACTGGAAAA
770001 TTGACTATCA AGCACTCCTA GAGTGGGATT TCAATGTTGT TTTAAAATGG
770051 AATTCTATGC TATTTCTCTT AGTTGCTTCT CTGAGCTATC CACAATAGTT
770101 TTAATGCATT GCAAGTGTTT TACACACATC CTGCCTTAAT AAAACATGTA
770151 ACGAAATCTT AAAACCCAAG CCTAGTTGCT AGTGAAAGTA GTCAGAAAGC
770201 AGATGAGAAA AATCCTGTTC AGTAATAAAA TATAAAGTGA ATAGAAAAAT
770251 GCTAGCATCC TGACAGGCTA AAGTGGTCTG GTCAAAAAGA CAATGATGGG
770301 ATTATGAGAA ATTCCCTATT ACTAAAAAAG CTAAAACTTA GCAGTAAAGA
770351 GGTTCGTGAA GACATATTCT TCCTTTTTTA CAAACAGCCT CTAACATAAA
770401 TTAAGAATGT GTTAGTCATG TCCAATAGTG TAAATTTTAA AATAAATCAA
770451 ATTGCATTTT TATATTTCTG TATTTTTGAG AGGGACAGAG GAGGGGGAAG
770501 TTAAATTTTG CCTGTCTTTA AATATTAGTC TGTTCCTCCG TTTTCCAAAC
770551 TCAACAATGG TGACAATAAA CACTTTCTTT TGTCTTTTCC CTGGAGATAA
770601 GAATAAATGT TCACACGGAT ACTTTTGAAC ATTTTATGAA AACCTAGGCT
770651 ACATAAATTC AGGGTCAGTA TTATCATATT GCTAGGAAGG TGGATCATAC
770701 ACTAAACAGA TGAATTTCCT GCCTTATCTT GTGATTTCCT TAAGTACCAA
770751 GAAAAATAGT TGTTATCTTG TTACTCTTAA CTTTGGGATC TTATACAGAT
770801 ACATTTCCCG AGAGCTGCAC TGTTCCATAG AGTAGCCATT AGACACATGT
770851 GGCTATATAC ATTTAAATTT AAATTAATTA AAAGTAACTG AAGTTGAAAA
770901 TTCAGTTTCT TCATTCTAGT AGCTGTATTT CAAGTGCTCA CTAACCACAT
770951 GTGACTGTGT GCTACCATGT TGTAGAAAGG GAACATTTCT GTCATCACAG
771001 AAGTTCTGCT GAAGCACACT AGCTCAGAGG ACACTCAAGC TAATGCTCCT
771051 ATTGCCCTAT AGCCTTAAGC TAGCCAGTGA TAGCATTTTA AGAATTAAAT
771101 GACCTTAGGA GGTATAGGAG TATGACTTCA TAATCAGGTC AGTGTCAGAC
771151 TAAGGGAAAG CTAAATGTAA GAGAATAGAA ACTAAATTAA TGATGAAGAA
771201 AGAAGGGATG ATGGTTAGAA ACAGGGTACA CATTGACATT ATCATAAAAG
771251 GATAAAAAAT GACTCAAGAA ATCAGTGCTT CAACAGAATT TTTCTTAAAA
771301 TTTTTACTTA AGACATTTGT TATATGTTAT TTGCACTAAA TGCATCAATC
771351 ACAATGCTGA CTTTCTGATG TTTATTTGGG TTTTGAGATG TTCCAGCTAA
771401 GTCACACAAA AAATTATTTC TTAAGGTTGT AGGGAACTTA ACCTCCTCTA
771451 TACTGGTAGC ACATGTTTAA AACATATTTT CCTCTCGTAG GGTGAGCAGA
771501 TGCTTTGGAG CTACTTGCAA TTTTTGTTCA CAGCTTTTGT ATTTATCCTT
771551 ATTTAGGTCC TTGTACTCAC AAGTAGTTTT CATGCTTACC ATTATTTTGG
771601 CTTCTTCTGC TTGTAAAAAA AGAAATTATA GCATATGTAT TACTGCCTAA
771651 AAATAAGAGA GTAATCTGTA TATGTTTGCA TTTAGGTCAT TCTGTCCATT
771701 GAAGAAGGGT ACAGACTTCC AGCTCCCATG GGCTGTCCAG CATCTCTACA
771751 CCAGCTGATG CTCCACTGCT GGCAGAAGGA GAGAAATCAC AGACCAAAAT

FIGURE 3SSSSSSSSS

771801 TTACTGACAT TGTCAGCTTC CTTGACAAAC TGATCCGAAA TCCCAGTGCC
771851 CTTCACACCC TGGTGGAGGA CATCCTTGTG TAAGAGGCAT AATGTTGAGT
771901 TTTTTTCTTC TTGACAATTA TGGTTTCTTT CAGGCTATAG ATAATAATAA
771951 CAGGTAGAAA GGAAAAAAAT GCCTTGATAA CCATCTAGTT GTTGACTTTG
772001 TGGAAACCAT ATTTCATTTA TCAGCTGAAA AAAAGAATTA TTAACATTAA
772051 AGTAAAAATG GACTCTTTTA AAAAAAGATA ACAGATTCCC CTTCCTTTTC
772101 TCTCTCTCCA ATCTTTCTGA ATTACTTTGT TTTTATCTTT TCCTGTTTGG
772151 GTCTTTGATA TTTACATAGC CTTTTAAAAT TGATTGATCC TTCCTTACCT
772201 TTAGAAGTAG AGAGAGAGAG AGAGAGAGAG AGTGTGTGTG TGTGTGTGTG
772251 TGTGTGTGTG TGTGTGTGTG TGCAGCCCCT TTAATTTTCT TGCCTATTCT
772301 ATGTTACTGT CCCTGAATTT GAAATGGCAA GCCAGACAGG GGCAATTTGT
772351 GAATCAGCCC AGAGGAAGAA TATTTCCTGC TGATATGATC ACATCTAGTT
772401 GTTGTTACTC TCCATTCCTA AAACCAGAAA AGAACAGATA ACAAGACAAG
772451 AAAATGGAGG CACTCATACA CCATTTTGTA AAAGTCAGTA GACTTGAGAA
772501 GATCTACTCA CCTCCCTGTG AAGAGCAATT ATAAGAGGAA GAGTAGAAAA
772551 AAAAAGACTA TCATCTATAT CTGAAAATAT TACATTTTAA ATATCATTAA
772601 GTTAAAAACA TATTTCTTTA TTTAGAAAAA GTTGGACTTA GAAATAACCA
772651 GTGCATATCC AAAGCTCACC TTCTTCACTC AGGGGATGGC TGGGGCTCTT
772701 CAGACATTCA CCTTCAGATC ACAGGTTCAA GCCAGTGCAG GTTTTTAGTG
772751 ACAGTAAGGC TGAGGCTCTT CAAGGACTAT TTGAAACAGA CCTCAGTTCA
772801 CAGCAGAGCA CTTAAGAGTT CACCTATAAA TCACTAATTG GCAGCCTCAA
772851 TAAAGTGAAG CCAAGCATGA AATAGCTAGA GATTAAACTA TTACTCCGGC
772901 CCATCTTCCC TAAAGAAGTC CAGCACAGGA AGCAGTAAAG GAAGGAAAGG
772951 CACTTTGGAT TTTATCATGA AAACAATGGA CAGCCATGGA AGGATTTTAA
773001 GCAAGGGAAC AGCATGATTA CGTTTGCATT TCTGAAAGAT CACTCTAGGG
773051 ATGATTTACA CTGTGAGTGC AAAACAAGGA ACAAGACTGG AAACAGAGAC
773101 AGTTTTATGT TTTCAGTAAC TAAAGCTAGA AAAGATCAGG GCTTGACTTC
773151 TGAAATGGGA ATGAGGTTGG GGGTCAGAAG ATAAGAGAAT TTTATTATTA
773201 TTATCATTTC CTAATAATAA GTAATAATAA CATTTATTAT TAGGAAAACC
773251 AATGCATCTT AGTCACTGTT TGAATATGGA GGGAGGGAGG AGAAAAAGAA
773301 TCAAAGATGT TTGTCAAGTT TCTTTCTTAT ACAAGCTGGC TGATGGTATT
773351 ACCCCAGAGA GAGGGAGAGG GACAAGTTTT TGGAATAGAA ATGAGACCAT
773401 TTGAACATGC TGAGTTGCAG ATGCCTGTGG GACATCTAGA CAGTTATATT
773451 TATAGGTTGA ACCTCAGGTA AAAAGATCTG GACTAGAGAT GTAGATTTGA
773501 AGATCATCAG CATATAGATT ATAGCTGAAG CTTTAACTGT AGTTAAGATA
773551 GCCCACAGAG AGTATAAAGA ATGCATATAA ATAGTGGAAA GGATGAAACC
773601 CTCTAATTTA AGACATGAAC TGAACAAAAA GTACCCAAAG GAAACTGAAA
773651 AAGAGAAGCC AGACAAGTAA TCAGGAAAAG AGGGAAGAGC AGTATCATAG
773701 AAGCCAAAAG AGGAGAGAGT TTCAAGGAGT ATAATGTCCA AGCCTTCACA
773751 AAATTGCAGT AAAATAAAAC ATGAAATGTC TCCACTGGAT TCAGCAAGGA
773801 GACATTCAGG TGTGCATACA CAACCTTTGG TACAGCATTT TCAATACAGT
773851 TGCATAAGAC AGATTACAAT AGAGGAAGAG TGAATATAAG CTCAGAGAAA
773901 GGAGCAATAC ATAATACCAA TTTTTTTTTT TTCAAGAAAC CTGTCTCTGA
773951 TGAGAAAGAA AAGTAGTTAG AGGAAATGTT TCTTGGTTTT TGTTTTTATA
774001 TGAGTTATTG AGGTGACTTG GTCATGCTGT AGTATTGAGG AGAAAGAGCT
774051 AGTAGTGAGT CTGCATTAAT GGAAGAGGAT ACTGGCATCT ATAAACTGAA
774101 ATCCTTTAAT CTGGGCCCCT TGTTGTGGTA TAGAGTTAAC AGAATCCACA
774151 ATCAGTGCCC ATCAACAAAG CTGTCTGACT GTGCTATAGC TATAGAAGCA
774201 GGATGTAAAA ACCTTCTTTT TGAAGAAAAG CAGATAAAAC AATTTCCTCT
774251 CTGCTTTTTC AAGATTATGA ATGATCATCA TATTTGGAAA ATATTGATGA
774301 AGAATGTAAG ATGAGAAAGT GTCAAAAAGT AACAGGGATC CAGAGGTCAA
774351 GTCAAGATGA GAGGGTGTAT CTGAGGGCCA GAGATCTGTG ATTTAGTGGG
774401 CTGTTCAGCA ATCCAGCAGA AGAGCCCCAT GAGTGGCAAG CTCTGAGACA
774451 GCACTGCAGC ACGCAGGCCA AAAGTTGGGT GCTTTATATA AACTTGGCAT
774501 CTTGATTCAA TTCTAAAGTC TGATCTCTGG GAAACCAAAT CGAAGTTTTT
774551 GTGACTGATT TGCTATCCTC ATTTCTGACA AAGACATATG TGATACTGCT
774601 TTTGCCATTA ATATACTTTT GTTTGAGAAA CAAAAAGAAT CAGTGTTCTA
774651 AGGTTCACAT GCCTGAACCT TTATCAGCGT TCTCATTTTC ACAGCAGCCT
774701 GGATGGGTTC TCCTGCTCCA CCCTCTTACT TGCAATACCA CCCACCCACT
774751 CTGTTCCTGA TTCCAGAGAA CTGAGACTGT TTAGGGAGAA GAGACACAGT
774801 AGATTAAAGG ATAGCAATAT TACCTAAAGA ATGCCTGTTT TATGCTCATA
774851 AAACTGTGAC ACTGCTTCTC TATCTCCCAA ATTGCAGAGC CCAGTTGTCT
774901 GCCCCAGAGT GATGCTGGAT TAAGGAAACA TGACATATGT AGAATTTCCA
774951 TCTTTTCTCC TGTATCTCTC AAACCTGAAA AGGAGTCCAG GTGTATAATC
775001 CACTGCAACT CTTCTTAAAT TCTCCTGCAC TTTCCTTTTG TGTAGCATCC
775051 CCAACCCCCA GATTTCTCTC ACACTTATAT GCTGATATTA CTCTCTCATC
775101 TGCTAGGTCC CCATGGTTTT TATTCCATTC TAATTGCTTT TTTCTCAAGA
775151 CTCACCTGAG AAGCTGTTAT CCTTTCTCTT GACAGAGTAG TAAGGGGAAG

FIGURE 3TTTTTTTTT

775201 AAATTAAAGT GACAAAGGGA TGAGGAAGGC CATGAAATCC ACAGTTTAAT
775251 AATTTTATAC TAACATATTG AAAATGTAAT AATTTTATAC TAACATATTG
775301 GAAATTTCAT AAACCTATAT CTGCAATTGT TCCTCTCAAA GGTCAGAGTA
775351 CCTAAATTGA AAACATGTTG GTCATAGAAG GCTTTCATTA TTTGGTGCAG
775401 CAAATATTCT TGTGCCTGAC ACACTCCCAT GGGAATATTC AGAGCTCTGT
775451 GCAGTTCCCA ACATGCTTGC TTTCTCTCCT ACTCAAGAAA GTGTAGATAT
775501 ACCATATAAG TGAATGTGGC AGTATTATAA GTATAACCCT AAATCCAACT
775551 AACAGTAAAA AACTAATTTG CAGAACCACT GTATTAATAT AGGCAGTTAT
775601 CCTTTCATAA ATGTGAATTT CAAACTACCC TCACATTCAT TCACTTTACA
775651 ATAATGCCTT ATAACTGCCT TTCAAATAAT TATTTGTAGC TGTCATGTCA
775701 TGCACAGCCC TTGGGAGAAA GGACCCAGCT TAAGGCCAAG GTTGTGTGTA
775751 GAACAGCATC TGGAGCAGTG CCTGGCCATG CACTTTAAAA CACCTTTTTC
775801 TCCCTCTCCA CTAACCCTCA GGACTAGCCT TGTAGCTGCT CCCAACCCCA
775851 AGTATTTTCC CACTTTGTAG CTTGATAGCT ACATGGTGAC CCTTCACCCA
775901 GTCCTACCTC CCCCACCCTC ACCCACATTG TCCTACACAT TTATTCTGCA
775951 TTGTCTTCAA CCCTCGCCCC TGATTACTCC ACACATGGAA GTCTACTGAG
776001 TGCACCAGGC TGTAGTCAGC TGGTCAGTAT CCTTTAGGAC AGAGTTTCAA
776051 TGTAATGGGA AAATAATGCT TTCTTCTAAT CCCTGCTCCA GGTCCCCAGC
776101 ATGTCACTGA CAAAGAACTT GACACATTAG GGGCTTCTTG ACTATCAGCT
776151 CAAATGTGGC ATCCCAGGAT GGGCAGCAGT TGTCCAGATG TTGGCTACCT
776201 CAGAAATAAT GCTTTGCCTA GGCCAAGACA CCTTATGTAC TGTATATTGT
776251 TACTACCCAC TGGGCCATAA TTAGGGATCT TATAAGACTT TAGCAACTGC
776301 AACTACCAGC TTCTGTAGTA CATATTAGTC TATCTTGTAA CTTTAAAGCA
776351 CTTAGTTTCC AGTAATATGT GAATCATGAA GGTAGGGAAA AGCCCATACC
776401 AATACCATTA TTTAGAACCT CTTCTTTAAA AAACTGTGAA TAATGCTGTA
776451 AGACTGAATA GTACTATCTC TCTCCATTTA GCTAATTATG CACCAATACT
776501 GCTATCTTCT GAATACAATA ACTTCCAACA TTTTGATATA AAATTTTCTA
776551 CTTATTTTGA GAAGATTTTG TTCAATGCCA CATAGGCAAT ACATAATCAG
776601 CATTTGCTAA ATTGTTTATC TCTATACACC AAGTCATAGA CAACTTTTTT
776651 TTTTTGATTC TTGTTGCTAG CACTTTTAAA TATGCTTTTC ATGACAGAGA
776701 AATAACTGGC TGGCCAAAAC CAATGTTGAA ATTGAATAAT AAGCAAACTT
776751 TTGTGGAAGG AAGACAGAAT ATGAAAGATG GATCAGGAGA TTTGAAACTT
776801 CTATTTGCCC ATTAGAAAAA TCTAAATTCA GCCAGGCTCA GTGGCTCACA
776851 CCTGTAATCC TGACCCTTTG AGAGGCCAAG GTGGCAGGAT CACTTGAAGC
776901 CAGGAGTTCA CCAGCCTGAG CAACAAAGTG AGACCCCATC TCTACAAAAA
776951 ATTAAAAACT AAAATTAGCC AGGCATGGTG GCACATGCCT GTGGTCCCAG
777001 CTACTCGAGA GAGCAAGGTG GGAGGATCAC TTGAGCCCAG GACTTCAAGT
777051 CTGCTGTGCA CTATGATCAT GACACTACAC TCCAGCCTGG GCAACAGAGT
777101 GAGACTCCGT ATCTAAAAAA AAGAGAAAAG AAAAATAGAA AATTCCCATA
777151 AACTGCTGGC ACAAGATCTT TATAATATAA TGTCAATATC CATATTAATA
777201 CTGATACAAA CTCTTAATAT ATATTATCAA CAATAACTAT GACTGCCATT
777251 TGTTGAGAGC CTACTATGTG CCAGTTGTGG TACTAGGGGC TTTTATTGGT
777301 TATGTCACTT AATCCTCACT GTTATTATTC CCATCCCTTA GACACGGAAA
777351 CAGAGACATA AAGAGGCTAA CTTTCCCAAG AGTACACAGC AATAATGAGT
777401 AGATCAGGAA TTTGAAGGCC ACTGACTCCA AGTCCTTGCT CTTTCCAGTA
777451 TACAACATAG AATCACACAG AAAGGCAAGA TGTTTGCTAG TACAACACTG
777501 CTTCAAAAAT ATGATTCTAA GAAAAGGGGG TACATTTTCA CATTTCCAGA
777551 TAGATTTTAT CTGGACTAGT CAAACTTCAT AGATGGAGTC TATTAAAATT
777601 CAAAAAACAA TTCTTACTGG AGAGCAGCCT GTTATTTTAT GTCCCAGTAG
777651 GCAAATACTA GAATGTAGAG AATATGACCT TAGTCATGGG AATAAATAGA
777701 AAATACATAG TCCATATATC CCCCAAACAC CCTCCCACAA TGCCCAGCCA
777751 CTTGAAGAAC ATTACTTGAA AAAGGAAAGT AGTAATAGCA ACAATATAGA
777801 GAAATGAGGA AAATATGGCA GTAACATCAC ATAATTCCAG AATTACGTCC
777851 TCAGGCATTT CTGTAGATTG AATTTTTCTG GTGCTGGCAT AAATACGTTT
777901 TGCTTCTTTT TCTCACTATG GCAGATATTA CTAATCATCA CAACACTCTC
777951 CTGCTGAGTC CAGATTCTGC CTTAGCATCC TTCTCATGAC AACATTTTGA
778001 CAACCACTGC CAATGAATTG CAGTTGGCAT GTGACATGAG ACCTATTTTC
778051 TGATCCTGGA TTACTTCCTC ACAAAAGCAG GCTTTTCTTA AGGTTCAGGG
778101 GTCTATTACT CTGGCCGTAG GAACCATGTG CTGGGTACAC TACTGGGAAT
778151 TATGGGAAAT TCTTTATAAG TATTATCCCT GCTCTGCATC TGTTCCTCTT
778201 AATGTTCAAA CATATCTACA ACTTTAAATT TTACTTTGAA ATTTTAATTT
778251 TCATTCCTTC ATATTTTTCA CTAGTTATCA GCCTTATTAT GTTTAAATAA
778301 TCATATCAAT AAAAAACAAT TGAAGACTTA CTGAAAATAA AAGACTGACA
778351 AAAGATAATT AATGTCCTTA ACACTGTGGA GTTAGACTGT TTGAAACAAA
778401 TATATATTAC CCACAAGCAC AAAATATCTG TATCTATATC TATATAGTAT
778451 ATGTCTACGC ATTTGAGGTT TCATAGCCCT TTGAGTAAAA TTACACTTTA
778501 AAAATGTTTT AAATATCAAA ATTATTTCAT TAATTTAATG TGTTCACATT
778551 GAATGTTAGG CTTAATTGCA GACAGGACTT TTTAAAAATA TATGATTATG

FIGURE 3UUUUUUUUU

778601 TAAATTCTTC TTCCAAGGGT ATGTACATAG TGTATGCATG ACAAAATTAT
778651 TTCATGGATT AAGTGAATAG TGTGAAGTGC AGTCCCTGAG TCACGAGATG
778701 AGGAACTCAT GTAAAAGCAG CCATATTGCA TTAAGTCAAT GTGCTGTTGT
778751 TGCTCTAGGT CTGGTTATAA TTGCAGGTGA ACCCTTAACC CTAAGCTACC
778801 CAACTCCACC TATCACTGCC TCTTTCTCCA CTCTGAAACC TATAAAGACA
778851 GAATAAACAT TTTCGCAATA CAAGGAATAA TTTGAATAAA CAGCATATTA
778901 TTTAATAAGT TGACCACTAT ATCAACAGGT ACTTACTCTT CTAGGTTCTT
778951 TATTTATTGG AATTAAATGA AAATATTCAT CATGAATCAG CCATCATGTT
779001 ATGGACCAAA CTGTTCTGTA GATAATTTAA TATTCAAGTC TGAGTCATCA
779051 CGTATTTAAT GAACTCCTAT AATGTTTTCA GCATTATGTG AGTGCCTACA
779101 CAAAAACAGA GAGATGTGTT CCTGCCCTCG GGGAGTTTTC ACTTATTCTT
779151 TTAAAAAAAT CTGTCTTATG AATTTTTCCC AAAGAAGTTA TTCAATTGAA
779201 ACAAAAAGAA ACATGCTGTA AGACTACATA CTCATGTCTA CTAAAAGAAT
779251 GTTGTTAGCA ACCTAAGAGT CTAACTTTAG AGAATTAACA AATTATTAAG
779301 CATCCACATA TAGAATAGTA TGCACCCATT TGAATATGAA AACTGCTGAA
779351 ACATGGGATA CATTCATGAA TATGTGAAAT GAAGGCAATG TAAAATAAAA
779401 TGGACCCTAT CTGTACATTT CTGCTAATCA CATATACATG TATTAGCTAG
779451 GAAACAAGAA GTTGTGTTAG AGTGCAAGAG AAGAAAAGCC TTTAAGCATT
779501 ATGAGGGTGT CATGTTAAAA CAGAATCTTA GCTTGCAATA GTGTTTCTCA
779551 AAATATAACC TTTCTTGAAT CATTTTAGTA TGTCTATTAC TATTATATAT
779601 TTATATGATG AATATAAAAC ATGGAAAACT TTGAGGATAA AACACTTCTT
779651 GCTTTTTAAT GGTAGTATTG ATATATATTG ATGACCTATC TAAGGAATTT
779701 CTAAGTTAAA ACGCTAGTAC TATTGTGAAC TCAAAGGGCT CATTAGAGTA
779751 AAAACTTCTG GACTCTTACC AGAGCTACTC ATTTTTAAAC ATATTTTATT
779801 GTATTGAAAT TTTATATTTA TTACTAAACT GTAACATTAC CTGTAATACC
779851 TATACTCCAG CCCTTTCTAT AATCTAAATT AACCATAATT TTACCTGAAA
779901 TATCCTAATT CTAGCCCCAT TCTCATTTTT CTGAGGAAAA AGTTGATCCT
779951 TGACCTTCTA TTCTACAATA AGTATTTTTT AAAATGTGAG CTGCAGGTTT
780001 TGCTGTAAAG ATATTTCTCA GGTGGGCAGT ACTCACTAAT CACCAAATAG
780051 CACAAATTTC TACATGCTTA GCAAATAGCA GACTAAATTT ATCATTGTAC
780101 ATGTTTGATA AGAAAGGGCA TTTATTGTTT ATTAGGTAAT ATTCCAGAGT
780151 AATTCATGTG AGGATAATAG TACCAAGCCC TCGAAGCCAG AAAATAGCAA
780201 CATTTTTCAA CTTCCTTAGA AGATAAGGTG AAAGAAAAGT TATTGCACAG
780251 TGTCTGTGAA CAATGAGGGG ACCCTGACCT TACTAAATCA ACTGCCAAGG
780301 CAGTCGTATA AAGGCCAAAG AGTAACTAGG TCACTGAAGA TGCGTGGAGA
780351 GAAAGGGAAT TATGGTATTA AAGCATTCTG GAAGCAAATA GCAGATGCTT
780401 TTCAACAAGG GAAATAGGCT ATTTAAGTCA TTTAACATAC AGAATGTCCT
780451 TCCATGACCT TTTATACTAA GGACATAAAA TTAGCAATTT ACATTTCCAC
780501 TCACCAAATA TATGAAATTG TGAAATTTCA AGAGTGATTC CAGTGTTATC
780551 TCAGGAGAAA GAAGTAGAAG TCATCTGACT ATGTCGGTGC ATCGAGAATG
780601 GCATAGGAGT ATGAAGGGAA AGTCACTTTA ATACATTCTT TTAATTTTCT
780651 TCAGTTTTAA CGAACTACTT TGACAAGTAT TTAAAAGACA GGAGAGTCAC
780701 GTTTTGAAAT AGGACACTCA ATTTTCTAAC ATGTGGTTTT ATTTATGTTA
780751 ACAAGCAACA AGGATATCCT GGTCATTTTG ATATTTAAAC TTGGTTAGTG
780801 AAGTATGGTA TATCCCCTGA AACTGGTCAA ATAATTTAGA AAAATAATGT
780851 AGAAGCTATT CTGAATTATC TTACATATTT ACAATGCACA TTAGAGCAGT
780901 GAAAACTCTG AGAAATGCTA CAACTTAAAA ATCTGCTTCA CAATTTTTGC
780951 CATGAAGACC TTTATTATTT TGTATTTTAC ATATGAAATT TTATTTTACA
781001 ATATTGATTA ACATAAACAC CTCTAGGAAA CTTTGAATAA ATACAGCAAC
781051 AATTCAAGTA TTTGTTGGTA GATGCTATGA TAGNNNNNNN NNNNNNNNNN
781101 NNNNNNNNNN NNNNNNNNNN NNNNNNNNNN NNNNNNNNNN NNNNNNNNNN
781151 NNNNNNNNNN NNNNNNNNNN NNNNNNNNNN NNNNNNNNNN NNNNNNNNNN
781201 NNNNNNNNNN NNNNNNNNNN NNNNNNNNNN NNNNNNNNNN NNNNNNNNNN
781251 NNNNNNNNNN NNNNNNNNNN NNNNNNNNNN NNNNNNNNNN NNNNNNNNNA
781301 TTTAATTTAT GTTAATTCCC AATCATATAT AAAAGAATCC AACCCCCCAC
781351 CCTGTAATCT CTCTTCACCC CACCTCCACC TTCAAGCTAG ACCTCAGTTT
781401 AGAAAAAGGT AGGTCAATGT AGTAATAAAA GGAAAACCAA ATAAATGAAT
781451 TCTAGGCCTT CCAAGGGCAC CTTTCAGAAT CTTCAGGAGT TGTACCATAT
781501 ACAACTTGTG CTCCTAAAAG ACTCGGGTCC TGGTGACTTT AGGGTGACTT
781551 AAAGGATTTT TAAGGGTAAT TTTGATGGTT AGGGAATTTC AGTTTTTACC
781601 TTAAGTATTA ACCTTAGGAC CTAATTCCCA TATTATTAGT AGAACAATAC
781651 CAGGGTTATA TAGCATGTAT ATGCCCTTCT GCTTCACAGT AGGGGAATTC
781701 TTACTTCACA TGGTGTAATC ATTTGTGCTC GTAGCTTATC AATTGCTAGT
781751 TAAAGCTGAA GTAGTTCAAA TGTGAATGGT AAAAACACTT TGATAAAACA
781801 GTCGAAATAT GAACATTAAA ATCTATGGCT CTAATTGTCT TTGTAGATTC
781851 TTTCATTCTT TAACTTTATA AAACTTAAAA AACAAAGTAA ATGAAAGTTG
781901 AACTAACTTC AATATTCCAA TAAAAATAAC TCAGTGATTC ACTTCTAATA
781951 AGGAAGTTTT TCATTACTTA CAACATATCG ATTTCACTCA AACACTAAAT

FIGURE 3VVVVVVVVV

782001 TTTTTTTAAA GATTGTTACT GCTTTACTAG TTAATATAAA TTACAGATCT
782051 AAAAATTCTT TAAATGATAT ATTTATTACC ATAGAGCTTT TGTGACACAT
782101 TTATTACTAT AAAAGCACTT TTACCACCAA GTATTTTTTA AAACATGCAA
782151 AATATTTTAA TGTGTATTTT TATGTAAGTA TGTAAAGAAA CTAATACAAT
782201 TTATTGTCAG AATGGCTTAA ATACACAATT CTGAGTTACT TTTACCAGAA
782251 TTTATAAGAT TAATTCTGTT TTTATTCTCT CTGACTTAAG CTATTATATA
782301 TAACTATTTC ATATATATTG CATATAAATA TGTGTATGTA ATGTATATAT
782351 AAGCACATGT ATACCCTAGC CTTTCCAAAG TAATACTTTT ATACTTCCCC
782401 TTGCATCAGA TCTGAGAAAC AAAAATAAAG ATTGCTATAT CATTGCCTTT
782451 AAGATCCATT TTCTTGTTAA CCCAACCTAA CATTGATTTT GTGTTGTTTT
782501 GTGCCTTATT AATATCTGTG CTTTGGGGAC ATTACCCTAG CTTGTATGTG
782551 TGTAAATCTT ATTCATGCAA CTGAACTCTG TGACAATAAA AATTACATTT
782601 TAAGAAATGA TAAATTATTA TTGAATGTTT GAGAACAGAC AAATGGAAGT
782651 TTGATCAATG AATTCACCAT AAGAAGGAGA AGAACTATCA CAGCAAATGT
782701 AGAAAAGGAC ATGGATTCAG GGGTAGGTCA GACAGGGGAA GAATGAACAT
782751 CCTGTGGCTA CTCTCCTTGT GGGGATAAGG GATGGGCTAT TCCTTAAGTT
782801 TCAAAACAAA ATTTTATGCA AGAGAAAAAA GTATAAGAAG AAGGGGGATA
782851 GCAAGATGTG AGTTCTCTCA ACATCCATCA TAAAGAAATT AAAAAGAAAA
782901 AAAAGATCAA TGTAAGTCCC AGTCATAGCA AAAAGCACAA AAAGACAAAA
782951 GTGTTCCACC AGATAAGTCA CTGATTTGAT AAATAATTTT TTAAAGTGAC
783001 TGATTTGAAT AAGATAGAAA ATCAGAGGCT TTCAAATGGA GAATAAAAAC
783051 ATTAGATGTA AGAATATTGT AAAAGTAAAA ATAAAGTTCC GTGATTTGTG
783101 CTTTATTTGG CTTTTAAATG CTCTCCATGT TTTGTTTTGT TTTGTTTTCT
783151 TACAGAATGC CAGAGTCCCC TGGTGAAGTT CCGGAATATC CTTTGTTTGT
783201 CACAGTTGGT GACTGGCTAG ATTCTATAAA GATGGGGCAA TACAAGAATA
783251 ACTTCGTGGC AGCAGGGTTT ACAACATTTG ACCTGATTTC AAGAATGAGC
783301 ATTGAGTAAG TGATACTAGG TTTATTACTG TAACGAGATG TCCTGCTGGG
783351 GATTATAAGT TCAAATGCTG TATCAAGAAC ACCTTTCCTT AGGCTAGTGG
783401 GTAATTTCCA AGTCTTTGCT CACCATTTCT GACTATCATT CTAGTGGGAA
783451 GTTGGACATT ACACTTTTAG CTATTATTCT TTGAAAGAAT ATATTTAATT
783501 CAAATAGCTA TTTAAAATAT TTTAAATGTT TTCTAAAATG CATGTTACTC
783551 TCATCCAAAT CATAGACTTT ATGTCAACTT AATTTTACCT TGGCAAATTA
783601 TTACTCACAT ATATTAATAT TGCATAATCA GTTTCTATTA CCTTCATCAA
783651 ATAATGCAAT ATTATCATGT CATTTTCAGA GCTCCTTCTA GATATTATAA
783701 TGGTCAACCA TTTTCCACTA TTCTCAAAGA TTGTCTTTTG CCTACATGCA
783751 ATGAAAATAT TTAACATGTG CTTAAAAGAC TAAATGGTTA GTTTGAATCA
783801 TATTAAATTG CCATTGTTTT AAGACAGTAA TGGCAATTTC ATACAGTACA
783851 ACCTAAGGGC ATTTTTTCTA GATATCAAAA ATCCATGAGA AATCAAACGG
783901 AGTTCATATT ATACCTTCCA TCCTACATAA TCACCATTTT GCTAATACTG
783951 TTGCAAATGT ATATCATTAC CTAAATTATA TAGCATTTAC GCCTATGAAA
784001 TATCTGAGTA TTACATAAGT ACCTGTGTAT AAAATTGAAA TATATATATT
784051 ATTACATCTG AGATTAACTT TATGTATTCT GTGGATCCAG AGAAAAGGAA
784101 AAAAAGAAAC AAACTTTTGC TGCTCATTTA AATCTCTGTT TAACAAGTAA
784151 GCTACACTAT TTTTGGTAAC TGTGGCAGAG TGCTTATTTA ATATATTTAA
784201 ATATTCACTT TATCTTGCAT GCTTATTAGA TCTGAATGTT CATATTCTGT
784251 ACTCTCTCTC TCTCTCTCTC TTTCTTGCTC TCACTCTCGC TCTCACTCTT
784301 GCTCTCTCCT TTCTTTCAGT GACATTAGAA GAATTGGAGT CATACTTATT
784351 GGACACCAGA GACGAATAGT CAGCAGCATA CAGACTTTAC GTTTACACAT
784401 GATGCACATA CAGGAGAAGG GATTTCATGT ATGAAAGTAC CACAAGCACC
784451 TGTGTTTTGT GCCTCAGCAT TTCTAAAATG AACGATATCC TCTCTACTAC
784501 TCTCTCTTCT GATTCTCCAA ACATCACTTC ACAAACTGCA GTCTTCTGTT
784551 CAGACTATAG GCACACACCT TATGTTTATG CTTCCAACCA GGATTTTAAA
784601 ATCATGCTAC ATAAATCCGT TCTGAATAAC CTGCAACTAA AACCCTGGCC
784651 CACTGCAGAT TATTGCTACG CAATGGTAAA TAACTCAGCA TGGATGTGTA
784701 ATTTTGTATA AGCCGTATAT GGGAAGTGTT CACGGACTTA ACCTAAAAAA
784751 ATTTATCCAG GTGGGGCTTC CTTAGTGATG TATGTAGAGT GTGATGGTAG
784801 ATGAGAAAGA ACTAGTTGAC CTTTCTTTCA TGTTTTGTGA TCAAGTAGCT
784851 TCCAAACTGA CAGAAATGTT TCATTTTTAG ATAATTATAT TCAGCTCTAT
784901 TGGTTGTATT ATTACTTTAT TTTTTAATAC TTTAACTGTT GGTGCCTGAT
784951 ATTGTTAGAA TTATTTGCAG AAATGACCAG TGATATCATG TAATGAATTT
785001 TTGTGAGGTA TGACTATGGT GAGAAGGGGG TTATTAGGGA GGGAGAAAAA
785051 AATACTGTGT TTATAAATCT TCTGAGGCTG GGTTTGTCAA TTTTTTAAAA
785101 ATTAACTTTA TAATGTCATA CATATTTCAT AGTAGGTGGT AGTTTAAAGG
785151 CTTTTCACCT CTAATTTTAT TTATTTATTT ATTTATTTTT ACTAACCGTA
785201 GTATATTTCT CTACTACCTT ATGAAGACCG CTCCTGGAAA GACCAAGGGT
785251 GACTTCATTG ATCTAATGGC TTTCATAGAG AAAAGCTTGG GATAAATCCA
785301 TGACTATTTC CTTTGTGCAT TGTCACAAGT TTGCAAAAGC AATTATCAAA
785351 GCACTGAGAA AATTGGTCAT TCTCAGTAGA ATTGCTTTGA ATAAAATACG

FIGURE 3WWWWWWWWW

785401 TTAGATTATA CCCTTAGATT TAATGTAAAA TTATTAATTT AATTTAAACA
785451 GAACTTTATG ATAGATACAT GGTGGCCCAA GAAAATAAAC AGACTTAGCT
785501 GATCATTTGG TATTGGCACA TTTTGCAAGT TGAAGCGTTC TTATGTTTTC
785551 TTTGCAAAAA TAGTTACATG AACATGCTGA GCTCTTTTCG AAACCTTCTA
785601 AGAAATAAGT ATGAATACTC CAAAGAGCAT ATAAACAGAT CTTACACATG
785651 AGCATAGTGT GTCAACCTGG GTCCAACGTA CAGTTACATA AAAATGAGAA
785701 CACAGCTGTG TTGTCATAAT CTTCTGAGAG GCTTAAAAAA CAAAGGTAAA
785751 TATATATTTT AAGTGATTTA AGCTGAGTTG GCTTATCAAA ATTGTGCTAT
785801 ATCTTATGAA CAAATTAAAT TATAAAATCA GCTGCTCCCT GTAAAACTAA
785851 AAAAATGACG ACTGTTTTAG GTGAAAGAGT AAGTAAAATG TGTTGAGAGA
785901 AAAAAACAGA GTAGGTTGTC TAAAGATGCT GATTTAATAA ATTAGCTTTT
785951 GTTGGATCTC AGTGATAATG GTGCCCTACC TACCCTAATT CTCAAATTCC
786001 TATCTAAATT CATTTTTTGT CATAGTAGTG GTTTTTTTTT TTTAAATAAA
786051 GGACCCTGTT TTTGTTTTTT GTTTTTGTTT TTGTTGTTCG TTTGTTTGTT
786101 TTTGAGACGG AGGCGTTTTG CTCTTGTTGC CCAGGCTGGA GTGCAATGGT
786151 GAGATCTTGG CTCACGGCAA CCTCTGCCTC CCGGGTTCAA GCGATTCTCC
786201 TGCCTCAGCC ACCCGAGTAG CTGGGATTAC AGGCGCCTGC CACCACTCCC
786251 GGCTAATTTT TGTATTTTTA GTAGAGACGG GGTTTCACCA TGTTGGCCAG
786301 GCTGCTCGAA CTCCTGACCT CAGATGATCT GCCCGCCTCA GCCTCTCAAA
786351 GTGCTGAGAT TACAGGCGTG AGCCACCGCG CCTGGCCATT TTTTTCTTAT
786401 ATTTAGATTT TGTTGATCGT CCCATTATAC T (SEQ ID NO:3)

FEATURES:
Start: 2026
Exon: 2026-2128
Intron: 2129-52852
Exon: 52853-52917
Intron: 52918-179879
Exon: 179880-180543
Intron: 180544-418112
Exon: 418113-418268
Intron: 418269-435837
Exon: 435838-436173
Intron: 436174-440414
Exon: 440415-440539
Intron: 440540-483836
Exon: 483837-483999
Intron: 484000-510557
Exon: 510558-510666
Intron: 510667-514500
Exon: 514501-514571
Intron: 514572-519142
Exon: 519143-519268
Intron: 519269-567117
Exon: 567118-567303
Intron: 567304-627380
Exon: 627381-627506
Intron: 627507-646004
Exon: 646005-646066
Intron: 646067-673094
Exon: 673095-673304
Intron: 673305-756014
Exon: 756015-756164
Intron: 756165-771685
Exon: 771686-771879
Intron: 771880-783155
Exon: 783156-783305
Intron: 783306-784319
Exon: 784320-784431
Stop: 784432

CHROMOSOME MAP POSITION:
Chromosome 3

ALLELIC VARIANTS (SNPs):
DNA

| Position | Major | Minor | Domain |
|---|---|---|---|

FIGURE 3XXXXXXXXX

| | | | | |
|---|---|---|---|---|
| 8559 | T | C | | Intron |
| 11577 | A | C | | Intron |
| 11857 | A | G | | Intron |
| 11938 | T | C | | Intron |
| 12962 | G | A | | Intron |
| 22603 | C | T | | Intron |
| 24577 | C | T | | Intron |
| 46498 | C | T | | Intron |
| 52424 | A | T | | Intron |
| 54224 | - | G | | Intron |
| 67262 | A | G | | Intron |
| 142589 | G | A | | Intron |
| 183578 | C | T | | Intron |
| 183599 | G | A | | Intron |
| 210111 | T | C | | Intron |
| 210813 | G | T | | Intron |
| 216608 | T | C | | Intron |
| 217136 | C | T | | Intron |
| 223811 | G | T | | Intron |
| 226568 | G | T | | Intron |
| 229094 | C | A | | Intron |
| 232802 | A | C | | Intron |
| 232883 | G | T | | Intron |
| 243587 | T | C | | Intron |
| 246715 | A | - | | Intron |
| 246717 | C | - | | Intron |
| 248108 | G | A | | Intron |
| 248515 | T | G | | Intron |
| 248696 | A | C | | Intron |
| 249229 | T | C | | Intron |
| 251313 | A | G | | Intron |
| 251468 | A | G | | Intron |
| 251543 | C | G | | Intron |
| 251912 | C | T | | Intron |
| 258852 | A | G | | Intron |
| 265029 | G | A | | Intron |
| 276141 | G | T | | Intron |
| 276484 | T | C | | Intron |
| 286381 | G | A | | Intron |
| 287546 | A | G | | Intron |
| 287595 | C | G | | Intron |
| 287655 | T | A | | Intron |
| 301688 | C | T | | Intron |
| 311457 | G | A | | Intron |
| 313130 | A | - | | Intron |
| 317525 | A | G | | Intron |
| 318781 | A | - | | Intron |
| 322483 | G | C | | Intron |
| 323093 | C | T | A | Intron |
| 326392 | - | G | | Intron |
| 327529 | T | G | | Intron |
| 327547 | G | A | | Intron |
| 329485 | A | G | | Intron |
| 338028 | T | C | | Intron |
| 338256 | G | A | | Intron |
| 353678 | G | A | | Intron |
| 354509 | - | T | | Intron |
| 359134 | T | G | | Intron |
| 383690 | T | G | | Intron |
| 409005 | C | T | | Intron |
| 409383 | - | G | T | Intron |
| 419889 | G | C | | Intron |
| 420071 | - | G | | Intron |
| 433013 | G | A | T | Intron |
| 439661 | - | G | | Intron |
| 440875 | C | T | | Intron |
| 453539 | C | G | | Intron |
| 453583 | G | A | | Intron |

FIGURE 3YYYYYYYYY

| | | | |
|---|---|---|---|
| 454909 | T | A | Intron |
| 455341 | G | A | Intron |
| 457421 | A | - | Intron |
| 457509 | T | G | Intron |
| 458009 | T | C | Intron |
| 467295 | G | A | Intron |
| 468045 | T | G | Intron |
| 468335 | G | A | Intron |
| 474258 | A | T | Intron |
| 474259 | A | C | Intron |
| 481073 | G | T | Intron |
| 487013 | G | A | Intron |
| 487048 | C | G | Intron |
| 487580 | G | T | Intron |
| 490479 | C | T | Intron |
| 490531 | T | C | Intron |
| 491847 | T | C | Intron |
| 495498 | T | A | Intron |
| 497751 | T | C | Intron |
| 504289 | T | C | Intron |
| 504315 | G | A | Intron |
| 515449 | - | A T | Intron |
| 515451 | - | T A | Intron |
| 515469 | T | C | Intron |
| 515473 | C | G | Intron |
| 515555 | T | - | Intron |
| 515887 | A | C T | Intron |
| 517766 | G | A | Intron |
| 519095 | C | T | Intron |
| 520168 | T | C | Intron |
| 520908 | C | T | Intron |
| 521734 | C | G | Intron |
| 524170 | A | G | Intron |
| 524245 | A | G | Intron |
| 524302 | T | C | Intron |
| 524438 | C | T | Intron |
| 525518 | T | A | Intron |
| 525847 | A | G | Intron |
| 527994 | C | - G | Intron |
| 528084 | G | A | Intron |
| 529495 | C | A | Intron |
| 530226 | A | G | Intron |
| 530326 | G | A | Intron |
| 530372 | A | G | Intron |
| 530407 | C | A | Intron |
| 530571 | T | C | Intron |
| 535153 | T | A G | Intron |
| 547552 | C | A | Intron |
| 547867 | T | C | Intron |
| 552396 | G | C | Intron |
| 556680 | A | - | Intron |
| 572534 | G | T | Intron |
| 573886 | T | C | Intron |
| 575479 | A | T | Intron |
| 576859 | - | T | Intron |
| 576880 | G | A C | Intron |
| 588934 | A | T | Intron |
| 591527 | C | T | Intron |
| 591634 | T | G | Intron |
| 591638 | G | T | Intron |
| 595008 | A | G | Intron |
| 595627 | T | C | Intron |
| 604393 | - | C A | Intron |
| 606325 | - | T | Intron |
| 607062 | C | T | Intron |
| 607105 | T | G | Intron |
| 611772 | C | G | Intron |
| 612925 | - | G | Intron |

FIGURE 3ZZZZZZZZZ

| | | | |
|---|---|---|---|
| 613447 | A | G T C | Intron |
| 613750 | A | T | Intron |
| 615704 | G | A | Intron |
| 619831 | G | A | Intron |
| 621458 | A | G | Intron |
| 621497 | - | C A | Intron |
| 623282 | - | C A | Intron |
| 623691 | A | G C T | Intron |
| 624893 | A | C | Intron |
| 627654 | T | C | Intron |
| 639109 | G | A | Intron |
| 643935 | T | G | Intron |
| 644067 | A | C | Intron |
| 646300 | C | G | Intron |
| 647248 | T | C | Intron |
| 647445 | T | A | Intron |
| 647757 | T | A | Intron |
| 650235 | G | C | Intron |
| 650543 | A | C | Intron |
| 650779 | G | A | Intron |
| 661781 | C | T | Intron |
| 662268 | T | C | Intron |
| 662994 | G | A | Intron |
| 663470 | G | C | Intron |
| 664153 | G | A | Intron |
| 664687 | G | A | Intron |
| 667140 | G | A | Intron |
| 667721 | A | T | Intron |
| 669600 | T | C | Intron |
| 670169 | T | - | Intron |
| 670488 | T | A | Intron |
| 672011 | A | G | Intron |
| 672608 | T | C | Intron |
| 674197 | T | C | Intron |
| 675175 | T | - | Intron |
| 675186 | T | - | Intron |
| 675386 | C | T | Intron |
| 675415 | G | T | Intron |
| 676698 | A | C | Intron |
| 681534 | A | G | Intron |
| 682005 | A | G | Intron |
| 682596 | T | G | Intron |
| 683691 | - | A T | Intron |
| 686990 | T | G | Intron |
| 687337 | C | T | Intron |
| 689158 | T | C | Intron |
| 689205 | G | A | Intron |
| 689569 | A | G | Intron |
| 690706 | A | G | Intron |
| 692682 | C | A | Intron |
| 693581 | C | T | Intron |
| 693656 | T | C | Intron |
| 696568 | A | G | Intron |
| 697865 | G | A | Intron |
| 700749 | A | T | Intron |
| 700948 | T | C | Intron |
| 703258 | T | A G C | Intron |
| 704216 | - | A | Intron |
| 704644 | A | G | Intron |
| 709159 | G | T | Intron |
| 709861 | T | G C A | Intron |
| 712946 | T | C A G | Intron |
| 719028 | A | C T | Intron |
| 721071 | A | G | Intron |
| 724053 | - | T G | Intron |
| 725192 | T | A | Intron |
| 725564 | C | T A G | Intron |
| 728076 | A | G T C | Intron |

FIGURE 3AAAAAAAAAA

| | | | |
|---|---|---|---|
| 733399 | C | T G A | Intron |
| 733447 | G | C | Intron |
| 782935 | G | A | Intron |
| 784250 | T | G | Intron |

Context:

DNA
Position

8559
AAGTAAACAACGGTAAATTTTATGCAATTAAAAATTTTATATGACCAGTCAATTACTGAT
TATTTTGAGTTACCTTTTAATACTACTACATGAAAATAATTATTAAATGTAGAGAACATA
AAAATTCTTAACACTCTTACACACTGTTTTTTAGAAAATTCATATTCTGGAGATACTTCA
TTTAAATGTTTCTAAATGTATTTAAACATATATCCAAATGCAGTAAATCTTACATTTTAC
TTTAGTGCTTTAGAATGTTCTGGAAAATACTATTTTTATAGTTATTTCATTTAAATAAAC
[T,C]
ATATAACTTCTTATGGGCTATACAGTTTCAGTTTTCAATTATAAATTCTCTAAAACAAAA
TGATTATTTAAGCAGATATTTATTGCCTGCTATATGACTAGGCAGTGTATTTGCCATACA
TAAAGGTTCAAAGAGAACTTTTTTCTCCCAGAATATATGATCCAGTAAAGAGTTTACAGT
CTGTTTCCAGATCTGATAGGAAAAATTTGTTTTCTCAAAATCAAATTAATAATCAAGTAT
AAAAGCTTTAAAAATGTATTTGTTATATGACAGTGTATACCAATTAACCCCAATAAAGAA

11577
AAATTTAATAATTTATTTTAAGGTTAGTAATCTAAAGTTTTAATAGGTTTATTAAAGCTA
AATGGTATATATATATTTTAAATGCTACCAAGCCTTAAAATCAGATAAAATTTTAAACAT
ATTTCTATTGTAAATTTCTCAAATATTTTGTCATTGCAATATATCTGTAGTTATCTTTGG
GTTTTTAAAGTTTATTCATTTTAATTTTTTTTCCTTTTATATAAACATTTAGGTTCTTAAT
CTCATAGGTTTTATATATAATATACATTTTTTCTGGAATTCTCAAACTAGTTCTGCAATA
[A,C]
GCAAATATTCATCCAATTTTTAAATGAAATATTTTGACACCTATTATGTTTGGTGTGTTG
AGAAACAGGAAACACAAAGGCAGGCCACTGCCCCAACTTGTGAGAGCTTACAGTTTAGCT
AATGACATCAGTAAATAATTAAAACAATTTTTAAATATCAAAGTTACATGTATTCAGCTG
TACAGTTGGTAAGTTACCATCTACAAACTATTGTTTACAGAAATGAAAAGTACTGTTCTT
AAGGATATAGGAATTAATATACAGAGACGTTGAGAATAAATATTCATTTAGTATATTGGT

11857
CTCAAACTAGTTCTGCAATAAGCAAATATTCATCCAATTTTTAAATGAAATATTTTGACA
CCTATTATGTTTGGTGTGTTGAGAAACAGGAAACACAAAGGCAGGCCACTGCCCCAACTT
GTGAGAGCTTACAGTTTAGCTAATGACATCAGTAAATAATTAAAACAATTTTTAAATATC
AAAGTTACATGTATTCAGCTGTACAGTTGGTAAGTTACCATCTACAAACTATTGTTTACA
GAAATGAAAAGTACTGTTCTTAAGGATATAGGAATTAATATACAGAGACGTTGAGAATAA
[A,G]
TATTCATTTAGTATATTGGTCATGACCATATGTTAGCCACGATTTGTGTGACTCCTTAAA
ATGAAATAAGATCTGCCAGCTCCCCCGCCCCTGCCCTCCCGCAAAGGACAGTGTTATAAA
ATTGAAGAGGTATAGCTGAAATTAAAATACAATATAAGATGGATAAAATGAAGAGAAATG
ATATAAACTTTACATACAAATAAGCCTGAGAACTTGAGAAGCTTGAGTTATACATGGGAA
ATGAAAATGAGTCTCACATTTATCAGGATTTATCATCATGAATATATGAAAATAATTAGA

11938
AGAAACAGGAAACACAAAGGCAGGCCACTGCCCCAACTTGTGAGAGCTTACAGTTTAGCT
AATGACATCAGTAAATAATTAAAACAATTTTTAAATATCAAAGTTACATGTATTCAGCTG
TACAGTTGGTAAGTTACCATCTACAAACTATTGTTTACAGAAATGAAAAGTACTGTTCTT
AAGGATATAGGAATTAATATACAGAGACGTTGAGAATAAATATTCATTTAGTATATTGGT
CATGACCATATGTTAGCCACGATTTGTGTGACTCCTTAAAATGAAATAAGATCTGCCAGC
[T,C]
CCCCCGCCCCTGCCCTCCCGCAAAGGACAGTGTTATAAAATTGAAGAGGTATAGCTGAAA
TTAAAATACAATATAAGATGGATAAAATGAAGAGAAATGATATAAACTTTACATACAAAT
AAGCCTGAGAACTTGAGAAGCTTGAGTTATACATGGGAAATGAAAATGAGTCTCACATTT
ATCAGGATTTATCATCATGAATATATGAAAATAATTAGAGAATTAAGATGAATGACTACT
CCAGAGACCTCCATTTTAAAGTAACTGAATTAGTTTTTATGCGTTTAAAGATTAAAACTT

12962
TAGGTAAATTGCTGTTTGATAGAGCCTTTATTTTTATATTTGAGAAGCACATAGAATTAG
AAATTGCTGCCAGAACTTGGTGTTTTTAAACAGAGAAAAATCAATAGCAGATTACCCGTG
ATTAGCTGTTGACATTTAGATTTGTACTTTTAGAATGTCAAAAGGCAGTGAAAACTATCA
ATCTAGTTTCTGTATTATAATTATACTCTATTTTTAAATTAAACATTTTATGGTCCTTCT
TCCCATATATGTGATATAGCCTTTTGGAAAAAATTAATTATAATAATTAAAGATATTTTG
[G,A]
TAAAAATGATGACCTTTAATAATTATTTAGTCAAAAATTAGAGGTCTACTGATAACGCTA
ATAGATTATCCCTCACTTTGAATACATCTAGGTTTTTTTGTTATAATTGCAACACCCTAT
TGCAGGCATCATTTTTAAATTGTGAAAATAAATATTTTTATAAGGTTAGATTAATATATT
TCTTCTATAATCTTTATACAGTATCTAGCATATAGTTATTTATTGCTGTCATAAAAGTTA
TTTTAATTCTATGCCAGATTATATATCATAAGTCTTTGATGTGTTTTCTCTGATAGTAGA

FIGURE 3BBBBBBBBBB

22603 GAAAGACTTTGTATAGGACGTGAAGCTTGAGATACAGGTTGAAACATGAGTGGGTGCTCA
TCAGATAATTAGTAGTACAAATCATTCCAGGCAGAGGGAGTATCAAGTGCAAGGGGATGG
AAAATTCATATGGGGCAGGGTGAGAGGTGACTGGCAAATAGTTGGGAATAGATAAAGACT
GTGAGGGGTAATGAGGCAAATAATGAAGGAAAATACACATGCATCGTTGAGGATAAGAAG
AGCCTTGAATGCTATGCTAAGTGGTTTTTGCTTTATCAAGAAGCCAAAAGTTCTTGACCC
[C,T]
GGCTGCATATCAAAATCATTATAGGGATTTTTGAAAAAACACCCATATTTGAGTCCCACC
CAGATTTATCTCTGTAAACAAGACTTGCAATGAATTTTGGATACCTTTCTTCTTACTCTT
GTGAAGACTCTTAATTATTAAGTATGTAGTAGACCCACATAAGTATTGTTTATTTCCTTA
ACAAATGTGGTGGAATGAATCTCGTCATTTCTGAATGGAGATGCATAGTAAACTTTGGCA
AGAAAAATTATGCAAAAATATTGCCAAGAATGTCACAGTATTAAGGGGAAATAAGCATCA

24577 GCATAGAGGGGTCAGCAAGGCTTCTCACAGGACATAATGTTTGTTCAGAGTATTGAACAA
CATTGTTTATGATGAGGGAGAATCAGCAGTAAAGGGCATTTTTAAAACATGGGAGAGATC
ATTCAAAGACAAGGAACGAATTTTGTATGTCTATGAAAGTGCAACTAATTTGGTACAGGT
GTCATTTAGAGGGCCAGGACAGATTGGAGACAGGGGAGCAATTGAAAAATGAGGCAGTCC
TAAACTGTTTACCAGGTCAACATGTTTCAATAATATCTTACTTTTGGACCATTTTCAGTA
[C,T]
GATGTCTTTAATACCTTTAAATAATAGCTCATTTAATCATTTTTGGTGTATTATGACAAC
TTTAGGCAGAGACATTTTGATTATATTATTAATACGTATAACAAAATCAAAATTAAAACA
AAATATAAGGCAGTATTTCATCTTTTTATTTGAGAATTAATGCATACTTTAAAGAATAAT
CTTTCAAGTTTTTTTTAACTTAATGTATCTTGGAGTTTTTTATTTAAATTTCCAAATTTT
ACTTTAAGTTCAAGGGTAAATATGCAGGATGTGCAGGTTTGTTACACAGGTAAACATGTA

46498 TTAGGTCCTAGTTAGGGAAGTTAACATCTATTTTCATTATGTCCATGTAAATGTAATGGA
GGGAACAAACAAAACTGCAGGAAGAAAAATTTTCCCATCTTCAAGAAAAAAGACTAAACT
TTCATTCTCATAATTTTTTTCACAGACTCAAAGTTATTTTTTTCCTTTCCAATATAAAGC
CACTGTTATTTTTTTTTAAAGTAACGGTTTCAGTAGTTTCTTTTAGACCTTTCTTCCATT
ATATAGAAATGGTTTTGGATTGAGATGGCCATTATATTGTAGATATAACTTACAAGTAAG
[C,T]
AGTTATAATCTCTTTTATCAGGACCATTAAACCAATGATTTAAGTGTATTTCAGACCTTA
AGTTTCATAATATTCTTCAAAAAATTGGAAAATGTCCAAAGCCCATAAAAGACTAGTGGG
AACATAAGAAAGGTTAGAACTAGAAAGGCAAGACACATGTTTGATGCTGTGTAAGCAATG
GGGAACATGTTCAATGGTTTGAGCTAAATGGGGCACTTCTTTGTGAGAGATGAGAGACTC
GCAACATTTATTAAATATAAGACTAGAAAATCTAAGACTATAGCCAAATAGTCTTTTCTA

52424 TCCCGTTTGTGAAGTTCTCCCAGAACTGCCAACCCAACTTTAGCTTAACTTAATTGCTAA
GATGTTAATATAATCTTCACTTTTATAACTTAACAGAAAATGTTGTTATGTGTTTACATG
TCTGCTTTTTTGACAAGATTATGAATTACTTTTGGTCAGGAAAAGAGATAGATGGTTTTT
ACGTTTGGTTTCGCATCTTATAGCCATAAGTAAACTACCTAGTGTATATAATAATAATGT
AGTCAGTGCTTTAAAGATTATAAGATTTTTCAAAATGAGTTTTTTTAATACTTGGCTGAT
[A,T]
ATATATAAGGACATTTAATAGCACAAAAAGAGAATCAAGAAATCTGCTTTAATACAGGAT
TTTCTTCCTGAATGTGGTCTAAAAATACTGTAAATGAAAGTGGGGAAAAGCAAAGGTAG
TTATTTTATCAGTTTTAAACATCTGCTATTAAAAAGACTTAATTCTGTTTAATAATTTCA
TTTAGCATTGTTTAACAAAAATATACATACTTTAATTTCTAAATACTTTATGCATTTTAT
CATTACTTAATACTATTTTATATTAATATTTAATATGTAAATTTCTGAAGATAACTCATT

54224 TCTCTTTAACAGCCCATTTGCTTCTTTAAATTTGTAAGTTTTATATACTGCGAGTTTATT
TTTCTGAAATTTTTGTTTATTCTACTAGAGCTCTTATCAAACTGTTTCTGAGGTATATAT
CTTAAACTAGGATTATGCTTTTATCTTCATTGTCTTATTTCCATTAAAATGAATAAACAT
TCGTATTGTTGAGTATATTAAGTGGGTCATGTTTTTACTTTTAAGAAATGAATGAAACTT
TTCTAAAATACCTTTTGTGTGTGTGCGTGTGTGTGTGTGTGTGAGAGAGAGAGAGACAGA
[-,G]
TGTGTGTGTGTGTGTGTGTGTCTAATCTTATGAACAGTAGAATGGATAGGTGGTATAAAT
AAGATTTTAAAAATATGCAATTTATTTATTTTTTCTTTTTTAGTGAAGAGGATAGATTAC
TGGTACTAATGGAGCTTTACTTAATGCTATTTATAGGTTAAAATAAGGAACTATTCAGTA
AGGATGAAGAACTTGGGAAAGAGGCTACTGAAAATGCCAAGAATGAAAATAATCTAGGTA
TCAATATAGGTTACAGTACTTAAAATCCACCAGAACCATTAATCAGTTTATAACATGTAA

67262 TTATAGTTGAATAATATTACATTGTATGTATATATCAGTTCGTTTATCCATTTATATATT
AATGAACATTTGGGCTTTGTGCACATTTTGGTTACTGTTAATTGTATTGCTGTGAACATG
TGTGTACATTATTTGAGTTCCTGCTTTCAGTTATTTTGGATATATACTTAGGAGAGGAAT
TTCTGGGTCATATCCCAATTCTGTGTTTAGCTTTACATGGAACCACCAAACTGTTTTCCA
TAGTGGCTGAACTATTTTTGTGTTCTCATCAGCAATGTGTGAGGGTTCCAGTTCCTCCCT
[A,G]
TCCTCACCAATGCTTGTTATTTTCCCTTTGGTTATTCTTTTTTTAATGTATGTAGAAATT

FIGURE 3CCCCCCCCC

GATAAATCATTGTATTAGTCTGCTTTCACACTGCTGTTAAAGACATACCCAAGACTAGGA
AGAAAAATAGGTTTATTGTAGTCAAAGTTCCACTTGGCTGGGGAAGCCTCACATTCATGG
TGGAAGATGAAAGGCTCTTCTTACATGGTGGTGGCAACAGAGAATGAGAGAGAAGCCAAA
GCAGAAACCACTTAAAAAACTATCAGGTCTCCTGAGACTTATTCACTACCATGAGAACCG

142589 TTGACTACCGAAAATTAAAGTCTTAACATTAAACCTTTTGTGTTCACAAGTTCAACATTC
ATAGCTTTGAAGTCTTTGTGTCCTTACTTTTCCTTAAAATTTATCCTTCTGTGCAGTGTC
TTCTAACAAATAAAGTTCTATTCAGGGAGACCTTACTTTTAAAACTTCCATTAACTTGTC
ATTATCTCAAATTACTGTGTTTAGCAGACATTAAAGGATCTTGGAAACATGGTGTGTGTC
ACTTTCCCAGCTTCATATTTCATCTTTCCCCATTAGTCTAATGTTCCAACCACAATGCCC
[G,A]
TCTTAGCATCTCGTAATTTCTCATGTGCTTCTGTATACCTATTAGAGGTTCTCTCATTCT
CTAGTTCTTGGATTGTCCAAGACTACTCATGCCCTAGTTCAAATACTAATGCCATGCCCT
CACCTATAAAGTGTAGGACCTCTTAGGCAGAGACTGTGCCCCTGTAACACCCTTTGCACA
ATACTGGTATACTGGTGTAAGCCTCTTTGCCCTTGATGTTCTGAAAGATACTGAGTTGCA
TTTCTCTCTCTCATGAGGTTGCAGCTTTGTGAAGTCAGGAACTGTGTCTTTTTCTCAGTT

183578 GTGTGTTCTTGATGTTGTGTGTTGCCCCTTTCTTTCCTCTGATGAGAATTTTATCATTGC
TTTTATTGCCATCTATTCATAACTTTTCTCACAAAAAAAATCTCTGAATTACATATAATC
AAAAGGTCAAACTAATTCAAACTTATATGAAAAAACTGTAGTACAAGTAGAAAAGTGACC
ACATATATAATAGGAAAAGAAAAAATGAGTATATCACTATTTTTCTTCTTGTCTATTCTG
TGTAAACAATTAATTAATCTACAGTATTGATTTTTTTTTAGAGACAGGGTCTTATTCTGT
[C,T]
ACCCAGGCTGGAGTGCACTGGTGCGACCATAGCTCATTCCAATCTTGAACTCCTAGGTTC
AAGCGATCCTCCTGCCTTAGCCTCCCAAAGTGCTGTGATTGCAGGGGTGAGCCACTGCTT
CCAGCCCCAAACTATTGATATTTTTGAGCATTTACTATTTCTTAATCACTTTCTTAAGTG
GTAGAGATAAACATAAATAAGGCATATGTTTCTGTTATTCATTGCTATGAGACAAAACAG
CCCAAAATGTATTGGCTTAAAACCACAATGATTTATTATTTTTCAGGGCTCA

183599 GAGAATTTTATCATTGCTTTTATTGCCATCTATTCATAACTTTTCTCACAAAAAAAATCT
CTGAATTACATATAATCAAAAGGTCAAACTAATTCAAACTTATATGAAAAAACTGTAGTA
CAAGTAGAAAAGTGACCACATATATAATAGGAAAAGAAAAAATGAGTATATCACTATTTT
TCTTCTTGTCTATTCTGTGTAAACAATTAATTAATCTACAGTATTGATTTTTTTTTAGAG
ACAGGGTCTTATTCTGTCACCCAGGCTGGAGTGCACTG
[G,A]
TGCGACCATAGCTCATTCCAATCTTGAACTCCTAGGTTCAAGCGATCCTCCTGCCTTAGC
CTCCCAAAGTGCTGTGATTGCAGGGGTGAGCCACTGCTTCCAGCCCCAAACTATTGATAT
TTTTGAGCATTTACTATTTCTTAATCACTTTCTTAAGTGGTAGAGATAAACATAAATAAG
GCATATGTTTCTGTTATTCATTGCTATGAGACAAAACAGCCCAAAATGTATTGGCTTAAA
ACCACAATGATTTATTATTTTTCAGGGCTCAGCTAGTAGTTCTGCTTAATGTACAATAAA

210111 TTCCATTCCCTGGAAGTGGCTGTGTGGCTCAGAGTGAGAATCTGTGTGTCTGGGAGAGGG
GCAGTGCAGCAACTGTGAGGCATTGCATTGAACTCAGTAGTCCTTTGTAATAGCAGAAAG
CAAAACCAGGCTGAACACAGCTGATGCCAACCCTCAGAAGGAGTATTTAAATCAGCCTCA
GCTAGAAGGGAATTGTCCATCCCGGCAGTCAAAAAATTGAGTTCTGGCAAGTCTCACCCG
CACATGCTAAAGTGCTTGGGGGCCCCAAATAAACGGGAAAGGCAGTCTAGGCCCCAATGA
[T,C]
TGAAACTTCTAGGTGAATCTAGGGCTGAACTGGACTCACAGCCAGTGGACTTATGGGGCA
AGTGACCTACACAGACACCATTTAGGGTAGTGAAGGAAATGCTCATGCTGCTAGATGTAT
TGGAGCTCCATTGTACGTTATTTGTTTCTTTTCTCTTGCTGCTTTTAGGATCCTTTATCC
TTGATCTTTGGGGGTTCAATTGTTAAATGCCTTTAGGTGGTTGTCTTTGGGTTAAATCTG
CTTGGTGTTCTATAACTTTATTGTATTTGGATATGGACATCTTTTTCTAGGTTGGGGATG

210813 TTCTAGATCCTGTAGGCATGCTTTACTGTTTCTTATTCTTTTTTTTTTTGTCTCCTCTAT
GTATTTTCACATAGCCTACCTTCAACCTCACTAATCCTTCTTCTGCTTGATCAAACCTGC
TATTGAAAGACTCTGATACATTCTTCATTTGTCCATCACATTTTTCAGCTCCAGAATTTC
TGCTTGATTCTTTTAAATTACTTCAATCTACTTGTTAAATTTACCTGATAGAATTCTGAA
TTTCTTCTCTTTTTCTGTCTCCCATTTATTTTGGGGTCTTTATTTGCATGCATTTTTACC
[G,T]
CTTTATGTGTAGGGACCAGCCCCACAGGGTCGGTGGGTCTCTCCCCATGTGCGGAGACGA
GAGAGTGTAGAAATAAAGACACAAGACAAAGAGATAAAAGGAAAGACAGCTGGGCCCGGG
AGACCACTACCACCAAGTCGCAGAGACCAGTAGTGGCCCCAAATGCCAGGCTGCACTGAT
ATTTATTGGATACAAGACAAAGGGGCAGGATAAGGAGAGTGAGCCATCTCCAATGATAGG
TAAGGCCACGTGGGTCACGTGTCCACTGGCCATAGGGCCCTTCCCTGCCTGGCAGCTGAG

216608 AAGGAAATAACTTATTTTCTCTGCTGAAGAGTTGTAAAATTCAATTATGCATAAAGACAA
ACATCATCCTGAGTAAAGAATCATCCGTAAGATTAGCGGAATGAATCTGCTGCAACATTT
ACACTTCATACTCTGAAATTGATTTTTATGCATTTTAATGGAAGCAATATTTTGCATTTG

FIGURE 3DDDDDDDDDD

AGTACATTACATAGGAAAATAAAATGTCAAGGCTTATTCCTCACAGAATTCACAATCTCC
GTTTCTGTTTCTGTATTTTTTTCTCTTTTTACTTAGAGGAATTGTTATGAGATGATCTAG
[T,C]
GGTCAGTTCATTTCTCATTCTTTTAGAACAATAATTTGCACATTAAAGTCCTAATACAAA
TAAATATACCCTATGTTCCCATCTGTTATTCTTACTCTATTGAGACCTAGTATAAGAGTA
GAGCAGTAAATGGAATACAGTCTTACTTCTCAACCATATCTTTTTTTCAAATGGCAAAAT
ATGTAAATATTTCTCATATGTTTAAATTTTTACTTTTATTTGAAACCACTAATGCCCAAA
TAATGCATTGATCTCAGTCATGGGAAGAGGTGGTAAGATATGATTAATATGTCTTTATTG

217136 ACTAATGCCCAAATAATGCATTGATCTCAGTCATGGGAAGAGGTGGTAAGATATGATTAA
TATGTCTTTATTGTAGCTTGCTGTGATTTCATGTAAAGAACATGCCATTTTATGACTCTT
ACTAGTGTAATGAATAAGTAAATTTTTAGCTTTAGAATTAATGCACATACCCTGACATTT
TATATCTAATTGATCTGAAAGAAATTCTAAAGAGAGTTAAACACTTTAAGTTCCCAAACA
TGAAGAATTTGAATAAAGCATGAAAGGAACAGAGAGCTATTTGTTGTTTACTTTATTCTT
[C,T]
GAGAAGCTAAAACTCAGAATCTAAAGCACAGAAGAAAATGTCCCAATTTTCAAAATCAAG
AAATCAAGAATCATGTTTACATGGTTTTTTTAACTCACACTTTCTATGAGCCAAGTGTTG
TATTTAAAGATATTTCATTGAACATATTGGACACAGTTTCTTCCTGCAAAGAGTTAACAT
TTGCAAAGCCGTTCCCTTATTACTTCCTGGATATTTTTTCCTTCCTATTTTAGTGTTAGA
TTATTTTAAGTGACTCTTGATTCTTATTTTTTTACTTGAAAAATATGGAAAAACAAAACA

223811 CCAATTTAAATTCAAAGAGTTAAAGAATACCGATTGATCATAATTATGAGGTCATCCTTA
TTATATAAGTTATTCAGGGGAGGAGTGACTGTGAAAATTTGAAGAAAAGTTAAGAATTTT
TTAGAAGTGTACCAGTACCGGTACCAAAACAGAGATATAGGCCAATGGAATAGAACAGAG
CCCTGAGAAATAATGCTGCATATCTACAACTATCTGATCTTTGACAAACTTGACAAAAAC
AAGCAATGGGGAAAGGATTCCCTATTTAATAAATGGTGCTGGGAAAACTGGCTAGCCATA
[G,T]
GTAGAAAGCTGAAACTGGATCCATTCCTTACACCGTATACAAAAATTAATTCAAGATGGA
TTAAAGACTTAAATGTTAGACGTAAAACCATAAAAACCCTAGAAGAAAACCTAGGCAATA
CCATTCAGGACATAGGCATGGGCAAGGACTTCATGTCTAAAACACCAAAAGCAATGGCAA
CAAAAGCCAAAATTGACAAATGGGATCTAATTAAACTAAAGAGCTTCTGCACAGCAAAAG
AAACCACCATCAGAGTGAACAGGCAAGTTACAGAATGGGAGAAAATTTTTGCAACCTACT

226568 AAGTGAGAGACAAATAATAAATTAATGTTCATTCTATGGAAATGAAATTGAGATTCAAGT
AGACCATGTATTTGATAAGAGCCCCAAATTAAAGCTGTATAGTTCAAGACTATAAAATGC
TGTTATGTCTAATCACCCCCCAAATTATAATACCTCTTTTGTCAAGTAATGAAAACTTGA
TATAGAAAAGGATACATCAGGCCGTTGTGGTTTTAGAAATCAAACAATATTTTCTGAGAA
TTGTTCTGAGCTAAAACAATAACAAAACCTCAGACTTTGGATTTGAAAGGGTTTACCTTA
[G,T]
TAGTCTGTTTAATTTATTTTTTAAACTTATTGCTGACCACAATCTGCCCATCTCTGTGTCAC
ATTATAAAATATATTCTAAGTCTACAGTCTAATTGGGAATATAACTTTAGGAACATGGGA
ACTTTAGGGAAAAAGAAACTTTCTTGACAAGGTTGTATTTAAGCATTCTTTACTCAACTG
ACATAATCAAATTATTCTGATAAAAATGAAAATATAGTAATTTTTGGATTATAGTTTCAT
GTTTCTATGAAAAACAGTTTGATCTTAGTGATGAATTTTGTACTTTCTGACCTCCAATGT

229094 GTGAATTATGTCTTTGATTCTTTAAATCAGTTTCTGTCTTGTTCTATTTTTGGTCAATTC
CTATTTTATAGAAATAGTATTAGGCCAAAGAGAGGACTAAATATGAAAATGCTTTCAAAG
ATTTCAAAGAAAGGCATATAATAAACACCAAATAGTATAATAACTATTAGTATCCCCATT
ATTAATGTTGTTATTTTCTTCATGATGAGCAGAGCAAAATCATTATTAAAAACTGAGCTG
TGAGTGTTTTTTGCATTTTAATCTTTCTGGCAATTTTCTTACCTAGCTTAAAAAGATGAC
[C,A]
CTGACAGCTAAGTCAATTGTTTTTTTCTCCCAACTTGGACGTTCTTCTATTTGAGTCCCT
TTGTATACACAAAGAAGGATTCAGTTCAAAGGAGAAGAGTCCTAGTTTTCAAGTGACATT
CTTGAGCTCTATTCTAGGCAGTACCCTTTGCTGGAGTTTTCCCTTGAACTAATCACTTAA
CATTTTACATTTACTTTCATCACCATAAAATATGGTTAATAATCTTCCTAGATGATTGTG
ACAATCATTAAATGAAAAGGTATATGTAATGGGCACTTTAGATCCTCTTCCTGTATTTCA

232802 ATGACTCAGAACTGAGAAAAATAACTGAACAACTTAAAACTGGACCTATCATCCTGTTGT
TTGAGACATACTATTGACTCCAGTAAGAAAACTGGTAGTTAAATTGAGTGAGAATCATAC
CTGCTAATTATAATAATGATAATTATTAATGATAAAATAATGATTATTATAATGATTAAT
TATAATAATGATAGTAATTTTGCTATTTATTACAAATACTTATATTTATCAGCACTCAAT
TATTGATGTCCACTTGGAATCCTGGATTTAAGCATTCTTAACTGTTATTGCCTTTATTTT
[A,C]
AATAAATTTTAGATACTTTCCCTGTGTGTCTTAAGTCTCAAGTATGGAGAGACACTGAAA
TATATTCAGCATAAAAGAGTTAGTATTATAAAATGGGTTTTCTGAGAAGGACTTTGAATT
AATATCCTAAATATAGATCATGTTTCATAACATAAAACAACTTCATTATATCTGAGATTT
CATATCAAAATCGGTTTTAAAAGTGAGAAACAAACAAAAGATAATAGATCTTTATTAAGG
TGTGTAAGCCATTTTCAATTTATCATGGCCTTTGGTCTTAAGGATAGAAAAGCTTATTAT

FIGURE 3EEEEEEEEEE

| | |
|---|---|
| 232883 | AGTAAGAAAACTGGTAGTTAAATTGAGTGAGAATCATACCTGCTAATTATAATAATGATA<br>ATTATTAATGATAAAATAATGATTATTATAATGATTAATTATAATAATGATAGTAATTTT<br>GCTATTTATTACAAATACTTATATTTATCAGCACTCAATTATTGATGTCCACTTGGAATC<br>CTGGATTTAAGCATTCTTAACTGTTATTGCCTTTATTTTAAATAAATTTTAGATACTTTC<br>CCTGTGTGTCTTAAGTCTCAAGTATGGAGAGACACTGAAATATATTCAGCATAAAAGAGT<br>[G,T]<br>AGTATTATAAAATGGGTTTTCTGAGAAGGACTTTGAATTAATATCCTAAATATAGATCAT<br>GTTTCATAACATAAAACAACTTCATTATATCTGAGATTTCATATCAAAATCGGTTTTAAA<br>AGTGAGAAACAAACAAAAGATAATAGATCTTTATTAAGGTGTGTAAGCCATTTTCAATTT<br>ATCATGGCCTTTGGTCTTAAGGATAGAAAAGCTTATTATGAATTCTTCATGCTGTGGGAA<br>CTTGAATTCCTTGGAGTGTTTTCTATATTATTATTTCAACTCTCTTTCTCTGATCAATCC |
| 243587 | TATTTATTTGTTTATTTTTTACTTTTTCATAGACTTAAACAGGAGAAACTAAATAATTGC<br>TGTTCTTTTGTTGAGTACTACCTAGGTAGAGAAGTTTACCATGAAATTATAAAATTCTAT<br>ATTTCAGGCTGATTATTTAGGAATAAAGTAGAGATAAAAATGTGATTCTCAGCATAACCT<br>TGGAATTCACTCACTAAATTTATATACTAATATCGAACTTGAATTTACTTAGTCCTGGTA<br>TGAAGAATTCTTTTGAATGAGGCTTCTATTGAATGAAAATATGGATGTTGTCAGAAAGAA<br>[T,C]<br>AAGTTTACCCAGGAAACATGTCCAATGATAATATTTTAGACAGGCTTGTCAGGACCCTTA<br>GAGAATTGTGAAAATTGAGAATGGCAATACATAATGGAGGCAATCTATGAAACAATTAAT<br>AAGCTATCCATCACTCATTTGTTTAACACTAAATAGTCTCAGTAGTTTCATCTGCTGACA<br>AAACATCTTGTAAACAACCACTGGGACATTTAGGATTTGGAAAATGTCACTGGAGAACTG<br>CCTTTTTCTCTAATAAATGGAGCAAAGAAATACTTATTAAATCTCCTCCGTAAGGAGATA |
| 246715 | CAAAGCCCTGTATCTCTATCTTAGAGAAACGCTCAAATTATATAATTTCAGGACAAACAC<br>AATCTTGATCTTCCCTTGTGTTTCACCTAACCTAGATGGCATTGGGTGGGTCTGTAACAT<br>CAGAACCAGGGTTCTTTCTGTTATAACACAGTGTCCACTGTCTGCCTTTGGCGTCATTCA<br>TGGCTAGGTAGTAACCAACACCTAGGGGCTTACTACATATGAGATGACAAAATTCAAAG<br>CAGCCAGCAAGTGCAAAAAGCATGTTACAAGGAAAGCAGCAGATTCTGACATAACTATCT<br>[A,-]<br>ACACACACACACACACACACACACACACACACAACAGATTAAGAAAACTACCTGAATCCC<br>TAAAAAGAGATAGTTTATCAAGATTTACAAATTTAATATTTCTTTCGAATGATTTAGTAC<br>ATGAATGGCTAAAAATAGGTTTCATATTTGCTCTGGTATTCACAAACACCAGACTGCAAT<br>TCACAAACACCAGACTGCAATTCACAAACGTGATTGCTATGAGACTACTGAAAATGAATA<br>TTAGTTATTAGAGAAAAGAAGGTGGAGTTGTCACTTGTGAAGAAGGGGCATTCCTCTACT |
| 246717 | AAGCCCTGTATCTCTATCTTAGAGAAACGCTCAAATTATATAATTTCAGGACAAACACAA<br>TCTTGATCTTCCCTTGTGTTTCACCTAACCTAGATGGCATTGGGTGGGTCTGTAACATCA<br>GAACCAGGGTTCTTTCTGTTATAACACAGTGTCCACTGTCTGCCTTTGGCGTCATTCATG<br>GCTAGGTAGTAACCAACACCTAGGGGCTTACTACATATGAGATGACAAAATTCAAAGCA<br>GCCAGCAAGTGCAAAAAGCATGTTACAAGGAAAGCAGCAGATTCTGACATAACTATCTAA<br>[C,-]<br>ACACACACACACACACACACACACACACACAACAGATTAAGAAAACTACCTGAATCCCTA<br>AAAAGAGATAGTTTATCAAGATTTACAAATTTAATATTTCTTTCGAATGATTTAGTACAT<br>GAATGGCTAAAAATAGGTTTCATATTTGCTCTGGTATTCACAAACACCAGACTGCAATTC<br>ACAAACACCAGACTGCAATTCACAAACGTGATTGCTATGAGACTACTGAAAATGAATATT<br>AGTTATTAGAGAAAAGAAGGTGGAGTTGTCACTTGTGAAGAAGGGGCATTCCTCTACTAC |
| 248108 | ATTCTTATTCACATTAAAGTCTGAGAACACAAGCTTATATATAGCCTACCTCATTTAAGT<br>CCTAGGAGTGTTGCAAATGTATTATGATACAGTTGCAAAGAATAAAAGAATGCCCCTCAT<br>CCATAGGGGGAACTTGGGAAATCTTAGCTTAAAAACCTCTACCAATTAAGATTCATGAGT<br>AGAAATGGTTTGTTTATAGAAAGATTTTTGCCTGGGTCATTAATTTTTAGGAAGGCTTATA<br>ATCTTTTAGGAGTTAGATTCATATGGAAATACACAAGGGTTTGCAGACTGACACTAAAAT<br>[G,A]<br>AACAGCTGAGTGCTTAAGTGTGGTAGGAGACATTAAGAAAACAGAATGCTTGTTAGATAA<br>AATGTAATGTTGAGGAACAACTGTCCTCCAGGTATCTATTTCCTTATAAAACACTTGCAA<br>ATGATTTTTCTAATAGCAAATCATGTATACAGTTTTTCAAGACTATAAGTATATTAAATA<br>GCATTTTCATATTTTTCCTTTGGCAGCACTCCTTTGATTTCTTTATTTTTAAGTAAAAAT<br>AATGTATTTCCTAGGGGATGACAATAATGAAAAGCTTAGTACCTAAAAAATATAGCAAAG |
| 248515 | TAAAACACTTGCAAATGATTTTTCTAATAGCAAATCATGTATACAGTTTTTCAAGACTAT<br>AAGTATATTAAATAGCATTTTCATATTTTTCCTTTGGCAGCACTCCTTTGATTTCTTTAT<br>TTTTAAGTAAAAATAATGTATTTCCTAGGGGATGACAATAATGAAAAGCTTAGTACCTAA<br>AAAATATAGCAAAGGGCAAGCATAGGCACTTTAGAAACTCAATTTTGCATTTTTAACTTG<br>GGAAGATTTTGATCTGATGTAATATAAGTTGGTATTTTAATTTCCAAATGTATTTAATTT<br>[T,G]<br>GTACACTTAAAATATATTCTAAACTTACATATTCTATACTTATGATTTGCCTAATATTAT |

FIGURE 3FFFFFFFFFF

```
           TAAAACTTTCTTCTGCAAAAGATGTTTAATATTACTGTAACCAGAATACCATCATTCCAG
           TACCTTGATGATTTAGAGAAAATCGAGATTAATGCTTTACACAGAATATTAGAACATGTT
           ATTCATCTTGTGACAGCTGATATTATTGCTGGAGTAGACAATACAGCATCGCAAACCTAC
           CTTACGTCTATTGGTGCTACTATATAATCTACTGTGTCTGAAAGTCACAATTTACACTTG

248696     AAATATAGCAAAGGGCAAGCATAGGCACTTTAGAAACTCAATTTTGCATTTTTAACTTGG
           GAAGATTTTGATCTGATGTAATATAAGTTGGTATTTTAATTTCCAAATGTATTTAATTTT
           GTACACTTAAAATATATTCTAAACTTACATATTCTATACTTATGATTTGCCTAATATTAT
           TAAAACTTTCTTCTGCAAAAGATGTTTAATATTACTGTAACCAGAATACCATCATTCCAG
           TACCTTGATGATTTAGAGAAAATCGAGATTAATGCTTTACACAGAATATTAGAACATGTT
           [A,C]
           TTCATCTTGTGACAGCTGATATTATTGCTGGAGTAGACAATACAGCATCGCAAACCTACC
           TTACGTCTATTGGTGCTACTATATAATCTACTGTGTCTGAAAGTCACAATTTACACTTGC
           TATGCGAACATACTTATTCATACTGCCCCCTTCGCTCTCAAGTATCCTGGTTTAGATAAA
           TTATATGCTCACCCTAAATTTGACATCCTTACATACTTGGAATTACAAGTCTCTTCTCCT
           ATCTAAACATTTTCACAAATCTGTTCTTTTATCAGCATCCCATAATAGGTAGCAAAAGCA

249229     CTTCTCCTATCTAAACATTTTCACAAATCTGTTCTTTTATCAGCATCCCATAATAGGTAG
           CAAAAGCACTGTCACAAGAGAAGGGAGGAAATTGGTCTTCTAGTTTGACCTTCTCCCTCA
           GTTTGGAAATGTTTGCACTCACAAGTCACATTACCTCTTGTTGGCTCTTGGCCTCATGTA
           CTGTATAACGCCAGAAGTAGAAAAATGTCCAGATTCATCTGTGCTCCTGGTGTCTTGGTA
           AAGGACGTATTGCTTGGATCTGGACCCAGACTTCACAGAGCCCCTTATCAGTAGTGCATA
           [T,C]
           GAATATAAAATAGTAGAAGTGTTTTAACATAGTGGTTGAGATCTTAGCCTCTGGAGTTAA
           ACAGACCTGGGTTTGCAACGCGGCATCTTCATTTAATCTTCCATTTCTCTGTAAAGTGGG
           AATATTAAAAGTCCTTTCTTCATTTCTCATAGGTCTGTTGTGAGGTATTATTGAGATAGG
           AAATTTTTCATAATACATTACACACAGTACCTATTATTTTGACTGCTACTGCCACCACCA
           CAATTATTGCTACCAAGACTCTTGCTCCTTCTAAATAAATTATACACTTCCCATAAGAAA

251313     CCAGCTAATTTTTGTATTTTTGGTGGAGACGGGGTTTCACCATGTTGGCCAGGCTGGTCT
           TCAACTCCTGACCTCAGGTGATCCACCCACCTTGGCCTCCCAAAGTGCTGGGATTACAGG
           TGTGAGCCACCATGCCCGGCCTGGAGTAAGGAGTTTTTAATCAAGTTCTTTTATTGTTAC
           TTTCAATATAGGTATTCAAATGATTTTAATTACTCAGGAGCTTAAATTCTCTTATTAAAG
           TGAATTTCTCCTTAATCACTTTTTGCCTACAACTGGACTTTGAAAAATATATAAAGATCC
           [A,G]
           TGAATCAATTCCACTGATTTAAAGGGTGTTCTAATAGAGGTAGCTTGAACAAGACTTCTT
           AGTGATTTATCTTATGTCAGTAAGATTGTTTTTATATTTTATATGCAAAGTGATTTATCA
           AAAACACAAAAGACTCAGACAAATCCTGGAGGGAAAATGTCTTTCTGATCTCAGGTTAAC
           CTCAAGAGCTTGGGTTATTCATTCTACAACTGGGGCAGCATGGAGGAGTGGGGGGACGCA
           GATTATCTCTGCCTGAACAGCGGAGTCTTTAGATCAAACACCAAAAATAGGAGATGAGGA

251468     TTTAATCAAGTTCTTTTATTGTTACTTTCAATATAGGTATTCAAATGATTTTAATTACTC
           AGGAGCTTAAATTCTCTTATTAAAGTGAATTTCTCCTTAATCACTTTTTGCCTACAACTG
           GACTTTGAAAAATATATAAAGATCCGTGAATCAATTCCACTGATTTAAAGGGTGTTCTAA
           TAGAGGTAGCTTGAACAAGACTTCTTAGTGATTTATCTTATGTCAGTAAGATTGTTTTTA
           TATTTTATATGCAAAGTGATTTATCAAAAACACAAAAGACTCAGACAAATCCTGGAGGGA
           [A,G]
           AATGTCTTTCTGATCTCAGGTTAACCTCAAGAGCTTGGGTTATTCATTCTACAACTGGGG
           CAGCATGGAGGAGTGGGGGGACGCAGATTATCTCTGCCTGAACAGCGGAGTCTTTAGATC
           AAACACCAAAAATAGGAGATGAGGAAAAAGACAAGCCTTAAGTAAAATATACAAAAGCAA
           AGCAGCTGGAGAATAAGAAAACTATTGTTTTCTTGGATGTAGGAGCAAAGAGAGGGACCC
           CAGAAGAGAGGAAAGCAAATATATGCCTCTTAGTATCTGATTTTCAGAGTCATTGAACTA

251543     CTTATTAAAGTGAATTTCTCCTTAATCACTTTTTGCCTACAACTGGACTTTGAAAAATAT
           ATAAAGATCCGTGAATCAATTCCACTGATTTAAAGGGTGTTCTAATAGAGGTAGCTTGAA
           CAAGACTTCTTAGTGATTTATCTTATGTCAGTAAGATTGTTTTTATATTTTATATGCAAA
           GTGATTTATCAAAAACACAAAAGACTCAGACAAATCCTGGAGGGAAAATGTCTTTCTGAT
           CTCAGGTTAACCTCAAGAGCTTGGGTTATTCATTCTACAACTGGGGCAGCATGGAGGAGT
           [C,G]
           GGGGGACGCAGATTATCTCTGCCTGAACAGCGGAGTCTTTAGATCAAACACCAAAAATAG
           GAGATGAGGAAAAAGACAAGCCTTAAGTAAAATATACAAAAGCAAAGCAGCTGGAGAATA
           AGAAAACTATTGTTTTCTTGGATGTAGGAGCAAAGAGAGGGACCCCAGAAGAGAGGAAAG
           CAAATATATGCCTCTTAGTATCTGATTTTCAGAGTCATTGAACTAGGTCTCTGAGAATCA
           AATTTTTCTTCTCAAATGATTTTTCTTTGTAATAATAGCCTATGCAAAATAAAACCAGCT

251912     GAAAAAGACAAGCCTTAAGTAAAATATACAAAAGCAAAGCAGCTGGAGAATAAGAAAACT
           ATTGTTTTCTTGGATGTAGGAGCAAAGAGAGGGACCCCAGAAGAGAGGAAAGCAAATATA
           TGCCTCTTAGTATCTGATTTTCAGAGTCATTGAACTAGGTCTCTGAGAATCAAATTTTTC
```

FIGURE 3GGGGGGGGGG

TTCTCAAATGATTTTTCTTTGTAATAATAGCCTATGCAAAATAAAACCAGCTGCCTCAAA
GGAAAACACACATCTTTCCTTGCATTCCAAATGCTTTGATTGGAAAGGAAATCTCAGACC
[C,T]
CTTAGGGCATTCCTGTCTCTTGGGGAAGATTATCATTTTACGATTTGATAAGTGTAACAC
ACATTGAAATTCCTGCAAGATGTTTGACTAGTATAGGATTTCATATTTTCAGTCATTAGA
ATGAATAAATTATTTCAGATATATTATCATCAAAGGTATTGTAATGTGGGGACACAGGAA
AAATTCACTTTTCACCTATGCATTCCTGAGAGCTAAAAAACAAATTAGATCATCATAGAT
CAGCTCATATTTTCACCCACACAATTTTGTTGTTGTGAATTTTATTTTTATTCCTGATTT

258852 ATTAAGAGTGTTTCTTCTACCATAGGCCTGATAGAATATTTGGCAATGCCTATTTTTCCA
GGAACTTCTATGCCTATTTTCCTAATAGGATCTCCTCGACAGAAGCTACACAGAATATAA
TAAAATATTTACAAAGCAATAACAAAAGTGAAAATTTCTCTAATAAATACTAGATATAGG
GATTACACAATGTATTAATTAAAGGTACTTTTATATATTTGAATATGAAAATGTCATTTA
TACTATTGACTTCAGTTATTAAATAGGTCATATGTCCTGAGGTTTTAAGGTTTTAGGAAA
[A,G]
CTAGAGAAGAGAAAGGTTTCATAAAATATTTCCAGGTAAGTCCTGCAGGAGACATACCAG
TGTTCCAAATGGGATGAGTTTCTGCTGATAAGACCCAAGAGAAGGAGAGGTTTATCTTAT
CAAAACAGATGTCAGTGGCTACTACCTTTTCCAGTATTTTGCAACAAGCAGCCTCACTGG
AGTCTTCTCAGCACAGTAAACAGTCGGCTATTTAGGAACTGTAGAGATTTCAGGGCAGAG
ATTATTTACAGGTATCTGTTTTCATTTTTTTCATTGTTGTTGTTTTA

265029 TGCCCATCAATAGATAAGTGGATAAAGAAATATATATACCATGGATAGCGTTCTATCCA
TAAAAAGGAATGAAATAATGGCATTTGAAATCCTCATTTTTTAGTACCTATGAAAGTGAAC
TTATTTAGAAATAGAGTCTTTGCCAATAATGAGGTTAAGATGAGGTTCTTAAGGTGGACC
CCAATCCCGTATGACTGGTGTCCTTATGAAAGAGGGAAATTTGGACATAGACACAGATCC
ATATTACAGGGAAGACAATGTGAAGACACATGAAGAACATCATCTATAACTAAGAAACTA
[G,A]
GAGGGAGGCACGGAACAGATTCTTTATCACAGCCGTTAGAAGGCACCAACCCTGCCTACA
TCTTGATATTGGACTTCTAATTTCCAACTGTAAACTACTTAAGTAAATTTATTGACTTAC
AGTATATGATGGTTTATATGGCAGTCCTACAAAACTAATACAGGGCAAAAACTAACTGAG
AATCATGAGTTAGATAATAATAACTGATTTGAGCAATTTAAACATGTCCAGTTGGTATTA
TGGCTTCAAATAGAAAAAGATCTTCATTGGTGATTAATTTGCAAGTCACTTATTTTTGTA

276141 CACACAGATTGCACAAATTTGCAGGCATATATACACAAAGATAATCAGTGGATCATTATT
TGTAATAGTTAAGTAATGAAAAAATCTGAAAGTTCATTAATGGAAAAATGGGTAAATGAG
GTTGTTGTATATACATACATGAAATTCTATTCACTAGCAAAAATGACAAGGTAAATTTGA
GCTAGAAAGATGTCCATGATATGAGGCAAAATGAAAAAAATGGGAAACATAACAAACAGT
ACAGTGAGTTAGCAGATGCATGTCAAACCCTTAAAATGCTTCTTCAAAGGTTTGGATAGG
[G,T]
GTGGTACATTTATTTCTTAAAGTGTGTGTGTGATGGTCACAACAATAGAAAGCAGGATGC
TTTTTTTTATCATTATACTTGAAGTTCTAGGGTACATGTGCACAACGTGCAGTTTGTTAC
ATATGTATACATGTGCCATGTTGGTGTGCTGCACCCATTAACTCATCATTTACATTAGGT
ATATCTCCTAATGCTATCCCTCCCTTTTCCCCCTACCCCATGACAGGCCCCAGTGTGTGA
TGTTCCCCTTCCTGTGTCCAAGTGTTCTTATTGTTCAGTTCCAAAACCACAATGAGATAC

276484 CAATAGAAAGCAGGATGCTTTTTTTTATCATTATACTTGAAGTTCTAGGGTACATGTGCA
CAACGTGCAGTTTGTTACATATGTATACATGTGCCATGTTGGTGTGCTGCACCCATTAAC
TCATCATTTACATTAGGTATATCTCCTAATGCTATCCCTCCCTTTTCCCCCTACCCCATG
ACAGGCCCCAGTGTGTGATGTTCCCCTTCCTGTGTCCAAGTGTTCTTATTGTTCAGTTCC
AAAACCACAATGAGATACCATCTCATACCAGTTAGAATGGCGATCATTAAAAAGTCAGGA
[T,C]
GCTTTTTAACAATATTACGCTTCTTTCATTAAAATTTTTACTTTTGTTGAAAATAGTTTC
AATTAAAAACAGATTGCCAGTTTTCCGTATTTACTACTTTTAATGGCAGCCCTTTTCTCT
TATTCAATTTTTAAATCTTACACTAATCATAGGCGATGGGGATCATTTTTCTCTCCATCT
TAAAGATAAGAAAACTAAAACTTCCAAATTATAGGTTACCTTACTCAAGATATCATACAC
CCAGTA

286381 GTCAGGGAGAAATTTCAATTCTGAGATTGAAAATGGCTCTTTTGGGTCAGTAACTATATC
GCTTCAGATACAGCGTGCATAGAGCAAAGGGGTTACCTCTGGGATTGGCTAAGTCATGGC
CAGATGATCCTCCATGCTGCTGACCCTTACAGCGTTAGAAAACCTATACTAGTCACAATA
TAAGGAGTTCACTCTCTGCTATGTAGCGTCAAAGTCATATGGCCTTTCAATAAAGTTTCT
TTTATTCCCTGTTCTGAAATATATAGTTACTGTTAACATGTGTTATGTTGATTATGTTAT
[G,A]
TTTAGTTGCATATTTGTAAACTACATATCTGTTTTTGTTTTCACGTGGAAATTATGAAAT
CCTAGAGCAAATAATCAGTTTCTCTTATTAGACCCCCCTAGCAATAAATATTTCCAAACC
ATTAAAGAGTGACTTGGTAGAATTTAATATTCTGGTCACGATATCAAAAGTAAACAGTAA
CTTTTAATCACTTTCTATTCTCATTATATCTCCTGTCATAACAAGTATTTTCTCAGTTTT
TAAATGGAAGAACAAGCAAGCAACAATTTAACATCAGTTGTCATCGTCTCTTAAAGATTG

FIGURE 3HHHHHHHHH

287546 GGGCTGCCATTAAAAGTAGTAAATACGGAAAACTGGCAATCTGTTTTTAATTGAAACTAT
TTTCAACAAAAGTAAAAATTTTAATGAAAGAAGCGTAATATTGTTAAAAAGCATCCTGAC
TTTTTAATGATCGCCATTCTAACTGGTATGAGATGGTATCTCATTGTGGTTTTGGAACTG
AACAATAAGAACACTTGGACACAGGAAGGGGAACATCACACACTGGGGCCTGTCATGGGG
TAGGGGGAAAAGGGAGGGATAGCATTAGGAGATATACCTAATGTAAATGATGAGTTAATG
[A,G]
GTGCAGCACACCAACATGGCACATGTATACATATGTAACAAACTGCACCTTGTGCACATG
TACCCTAGAACTTCAAGTATAATGATAAAAAAAAGCATCCTGCTTTCTTTTGTTGTGACC
ATACCCCCCACCTTCCTTTTCAAAATTATGTGGCACAGGCTGATAATGCTTACCATTATT
CAAACACTCATCAGACTAATGAAATTCCTGATTTTTAGGTGGGCTAATGGCTACTTAAAA
ATAATGACCACATTTCCTACCCTGCTTTTAAGTGATGTGTGGCCATATGACTAAGTATGT

287595 ATTGAAACTATTTTCAACAAAAGTAAAAATTTTAATGAAAGAAGCGTAATATTGTTAAAA
AGCATCCTGACTTTTTAATGATCGCCATTCTAACTGGTATGAGATGGTATCTCATTGTGG
TTTTGGAACTGAACAATAAGAACACTTGGACACAGGAAGGGGAACATCACACACTGGGGC
CTGTCATGGGGTAGGGGGAAAAGGGAGGGATAGCATTAGGAGATATACCTAATGTAAATG
ATGAGTTAATGAGTGCAGCACACCAACATGGCACATGTATACATATGTAACAAACTGCAC
[C,G]
TTGTGCACATGTACCCTAGAACTTCAAGTATAATGATAAAAAAAAGCATCCTGCTTTCTT
TTGTTGTGACCATACCCCCCACCTTCCTTTTCAAAATTATGTGGCACAGGCTGATAATGC
TTACCATTATTCAAACACTCATCAGACTAATGAAATTCCTGATTTTTAGGTGGGCTAATG
GCTACTTAAAAATAATGACCACATTTCCTACCCTGCTTTTAAGTGATGTGTGGCCATATG
ACTAAGTATGTGAGGGAAAGTGGTGTGTGTAACTCTGGGATATATCCTTAGAGCAGTAGT

287655 AGCATCCTGACTTTTTAATGATCGCCATTCTAACTGGTATGAGATGGTATCTCATTGTGG
TTTTGGAACTGAACAATAAGAACACTTGGACACAGGAAGGGGAACATCACACACTGGGGC
CTGTCATGGGGTAGGGGGAAAAGGGAGGGATAGCATTAGGAGATATACCTAATGTAAATG
ATGAGTTAATGAGTGCAGCACACCAACATGGCACATGTATACATATGTAACAAACTGCAC
CTTGTGCACATGTACCCTAGAACTTCAAGTATAATGATAAAAAAAAGCATCCTGCTTTCT
[T,A]
TTGTTGTGACCATACCCCCCACCTTCCTTTTCAAAATTATGTGGCACAGGCTGATAATGC
TTACCATTATTCAAACACTCATCAGACTAATGAAATTCCTGATTTTTAGGTGGGCTAATG
GCTACTTAAAAATAATGACCACATTTCCTACCCTGCTTTTAAGTGATGTGTGGCCATATG
ACTAAGTATGTGAGGGAAAGTGGTGTGTGTAACTCTGGGATATATCCTTAGAGCAGTAGT
TCACAAACTTTGTTGTGTACCATCATCACTTGAAGGACTTGTTAAAAAATAAAAAAAAAA

301688 ATACTTGCTGGATTCATAAGTTAGTGTTGTTATGAAACACAACTGTCTCTCATGGGCCTA
GTTCAGCCCAGTGGAACTAAATAGAATAAATCTTTTCTACTTGCATGGGAAGGAGAGTTG
TGTTAAGGATTTATAGCTTCATGAAGACTTTCAAGTTAAATTTTAAAGAAACTTGAATAA
AGCAACTGTCAGTAACTGTTGCTTGGAGTGAAAAGTGAAGACGCTAAGAGCTGCTACTTT
TTCAGCTTTTATAAAGTACAGAGTTGTTTTTGTGCTGGAAGCAGGAAGCTAGGAGCAGCA
[C,T]
GGTGAGAAGCACAAAACTCCGAGATGGAGATGTCAAGAAGATGTGCAGTATTCATTTATT
CATTAACTGCAGAATATTTACTGACCAACGACAATGTACTATGACAGATGCTGACAGCAG
TAAACAAGATGGACAGAGGCTCCTGACCTTATGAAGATATGGCCTAGCAGAGGATAGACA
GAAGGTTACACTTATTCAAATCACTAATGGTAATTGTGACAAGTACAGAAGTGATCATAT
GGTAACCTAACAATTTCCACCAAAATAATCACCGGGATTAGAAGGGCTGGGTTATATGGG

311457 TGTTAGCCAGGCTCCCAAATTTGTCTTTTGCCAACTTGATTATCACTTCCAATTAATCAG
TGACAAAACACTGAAACAAAGCAGGACAGGAGCAGACCCAAGCCAGGCTACTAAGAAACT
ATGCACTAACTCATTACTCTGCACACTTCATTCATACAACTGCTTCCAATTCATCTTACT
TTACCAGGATCTAATGGATATTTCTCTAGGTGCGTGTTGCCTACAAAATTATTATGAGGA
ACACTGTCAAATGTCTTGATGAAATAGACAAAATGATTCTACCTGTTTATGCCTCTGGGC
[G,A]
CAGGTTGGTCAGGTCCATCAACTAGTGAGATAGGAGGCAGTGTCTCCATGAAGACCAGAA
GCAATAAAAAGCTGAGCACAGACCAGTCTCAATGCAGTCTCAAAAATCAAAGCCGCAGAA
ACTTCAGGTACCACTTACAGGAAGAGGGCTAAAATAAAAGGGCAAATCAGTAGCTTAAAA
AGAAATGGAATTGGAGAAGATGAGACAGAAAAGCAGGAGGATTCTGAGTGATTACTATGA
ATGAAGAAATGGAAGTATTAATAGCTTTGTTTTGCCCGTGTAAATGGAGTTGTCTGAACT

313130 TTCCCTTGAACCAACCAAATAAGGTTTTTTGGCATTCATGCTATATTAAAAGGTATAAAC
ATAAATAATGTTATAGTGTAAATAAAATAATGTTATAGTGTAAGTAAAAATAAACACTGG
CTTCTAAAAAACATTTAATATATGAAAAAAATTTAATATTAGATGACAAATACTTCTTTT
TAATGTTTATTGGTGAAACAGATTCAGAAATGTTACGTTCCTGCCAAGATCACACAGCTA
TTCAGAGAAAACAGAATTAAATAAAATCCATATCCTTTTCAATATAATTAAATGCTTCAA
[A,-]
TGGAAGATATACCAATTTCTCTCTTCCCACTGTTTCCTAAAGCATGAAACCTGTCAATAC

FIGURE 3IIIIIIIII

CACCCAAACTCATATTATTTTAAGAAAGTAGTTTCCAATTATTTTGAGATCGGAATCCTT
TAGAGAATCTGGTTACAAAAACTGTGTACCCTTTCTTCAGAAAAATTTACGAATGCCCAT
TCCCAAGCCACATTTAAGTAGTAACCAGCTGGGCGGTTGTCTAAAGTGCTAATGTAAGAG
TAGCACTAAAATGACGCTAGAAATATGTTGAGATAGAAGAGGTTGTCTTACAGGAATTCT

317525 AGGAAATGCCACCAGAAGGGACCATTATTTTCCTCTTTGAACTAAATGTCTTAAGCTGTT
TCAGGACAAGCATTAACCTTTAGCTAAGAAAGAATTTATTTAGGATATATATTGAAACAC
ACTTCTATTGATTGTTTCTGGCATATTGCATTAAGTACAGAATATTTCTATAGAAGCAGC
TCACTCAGTTCAACAAGGTTATTTTTTTCCAGTTATGCTAATAGGAAATTTAAATATTCT
ACTACCATATGAATAGATAGGAATATTTCTATAAAATTTAAGATCACATCTGTTATCACT
[A,G]
TACATATTTTGGATTTCTTTTTCCCTTGAATGCAAGAATAAGTGCAGATATTTATTGAGA
GGAAACATGGAGCTGTTTGATTTGTCTCTGGCTTGTTAACAATTAAAGCAGATTATTTTT
TGGTATCTTAATTTTTCTAAATATAGAATATAGTTACCAGGTTATTCTCTCCTTCTTCCA
AGAGAAATTGAAAAATGACTAAAAATTCTTTATTATTATGTGGATAAATAAATGATTTAA
ATAAAATAAATATTTTCAGACAATAGTACTCAAACGTGTTTAATTATCAGTT

318781 ACGATGAAAAAGTAAAATTTATCCAAGTACTGCTTTATTCTTGGCATTTAGCACAAATGA
CAATATAACTCCACAAAACTACTTCCAAATAATTACATGAAGAAGCATAGTAAGAAACAA
TTTATTAACATGTCACTACTAGTTTTCTCCTAGGAATTTAGATATGCCACACCAAAAGAT
GACAAATTAATTCCCATTACACTAAACTTCTACTAGGTTCTTATGAATGTTACATTTGTT
CTCCTTTGTACTCTGCACTAAGGAATGATGGAAACTTAGAGCCTTCACCTGTGTTAAAAA
[A,-]
AAAAAAGATTTGAAGTAATAATACAGGAGAACCAAATTAAATCCATTTGAACTAAAACTA
GCATATTAATTCAGTTCTGCAGATGTTTAAATGTCAATATTAGTTTATTAAAAACCACTA
CAGTAAGAGCATAAAGAAGATGGACCAATGGAAGGAGGCAAAGGGAGAAGGTGAAAAAAA
AAAAAAAGAACACTTAGATCTAATTGAGAAACGAAAGAAAAAATTAAAACTGAAGAACAC
AATAACAAGGAAAAAGACTGCAGGGTAGGGAGAAATAACTTTTTCTCACCCATCCTAGAT

322483 GGGGCATTCTGGCTAAACTGATACAGCATTCTTGCTACATTTGGGTTCTTGAGAAAATGC
CCTAGTGGAGCTCAAGGAGATTAACTAGAGTTAGGTCAAGGAATAGTCTTTGTCAGTACA
AACTAAAATGGAACTTCAAGGTCTCTCATATGATCAAAATAAATATTATTAAGTATCTGT
CAAAGTGCATTTTGTTGATAAAATTATTTCTGCTTTTTACTACGGGTGGTGGTAGTGACA
GTACATGGAACTATTACTCATTTCTGATAACAACTTTTGATATTTTCTCTCTTGGATTAT
[G,C]
CACATGTCTACAGTATTCTGGGTACCCTTCCTACATTCTCTTACCATCTCGGGGTTGTTT
TTTTCTCTTTTTCTTCATTTTTTCTCTAGTTACCATCTGTCAAACTGGATATCTGTCAAA
CTGGATTTCTCAATTCTTCTACATATGGTAGTTAAATCCAATTTGCTTTTATTGTAAATT
GGTTTGGTCATAATTCAGGTTTAATCCAGTTTTTATAGGATCATGTTAATGATTTTGTTT
TTTAATATCTATGTTCTATTTAATTATACAAATATTTCTAGTTGACACATTTTATGACTG

323093 CTATTTTTGTCATTTTTCTGCACCTGTTAAAATATATCCATTTCCTTAAACAGACTTTAC
AACCTGAATTACAAAATTTCCACTTATACACATCCTAATTTGTTTCCTAACCTATTGATA
CATCTTTCCAGTTAGACAAGTTATTTAGCTATTCTCCTGCCAATATGCATATTAATTCAT
CTGACATTAGGGGAATATTAAGGAATGTAGACTTGAATAATTTGATTACATAAAACTTCT
AACAAGACTATGCCTATTCTAGGCTATGGGTCTTTCCTAGATCTGTTAAAAGTGAAAAGC
[C,T,A]
TTTCACTTATTCTACCGTGATTCACCCTTATTATAAACAAACCATATCCTAGTGAGAAGA
GCTAAATTTGTATTTTGGATGATATGTTCCGTGAAGAAATTATTATAATTATTGTATTGT
AACCACTTCTGTGCCATTTAATTGACACAAAGTGATCTTTAATCATTCAGCAGTTAATTC
TTTCATTATTCCATCAGGAAAAATCAATAGCACAGTTGATTTATATCTGTAGAAACTCTG
ATACTACAGTGGCAGATTAAAATTGTCATAGCAGAGAAGAAAAAGAACTCGTATTTAGAA

326392 GTCTTCTTCAGTAATTAGTTTAATTTGTTCTCAATAGGGAATTCTAAATTTTATCCTTTT
AAGTTTATCAACATAATTCAAGCTGTTGATTGCATAGTAGATTAATGATATGAGTATGAT
ATATAAAATTCTATTAGCAGCTCAGAGGGTGATTTTAGAAAAGTAAACATATTGGAACTA
AAGGAAATTGTTTTTGCCACTGTTTGTTTTCATGAAATTTTAAAAAAAAGAGCCTACATA
AATGTAACATGCTGCAAAATATGACTATAGAGTCAGAGGTCAGTTAAAAACAAATGAAGA
[-,G]
ATTTGATGTAAAGTTTATATTTCATATGCGTTTTATTTAGTATCCAAATGAGATTCTCCC
ACTTAATAAAATATCAACATATGAAAATAGCAACTCTTTCAATATACTATTTCTGAAGCT
ATATATTTAGATTGCTTCTTTCATTTATTTTTAGTATAATTGTTTTTGAAACTTTAATAA
GGCAAATTAGTAGTTCCTAGTTCTAGATAAATGTGAGAATCATACAGGGAGCCTTTAAAA
AGTACTGATATCTATGACCCACACTCAAGAGATTTGGAAGTAATTGATTTTATAAGTGTT

327529 CAATTGAGTTCCTTTCAGAGGATCTGTCTTTAGGCAGATAAGAGGAATTCAGAGAAAGCC
TCTCCCTGCGTTTGCTGTTTTTCAGGTACTTTCACCTCAGAATAATCAGTATACCAAAGT
GGCATATTGAGATGGCATATTTTGTTTCCTTGAGAGATGATACCTAGATGATACATAAAA

FIGURE 3JJJJJJJJJ

ACTTGAAAATACACGTATTTCAGTTATGCCCAACAACTAGCAGGATATGACACAGTGGCA
CAACGCTAACTTTTAAAGTTAGAATACCAGCATTCAGAACTTGGCTTTTGAGTTACAAGC
[T,G]
GCGTGAACTTGAGAAAAATCACTTAATTTCTGCAAGCTCATAAATTTCGGCTCCAGTTGA
GCTTTCTAATTCTAGAGCCCAAACCTTACTGATTGTATTTAAACATAGCTCCTGTTGTTT
TTCTTTGAACCATCTCCATCTGAAAAACTGGAAAACCATTTTCACTTCAAAAAATTTTGT
TGACACACAATAAAAAATTGTACTGAAAGTAGAAATCAGTACTAAGAATATGTTGCAAGA
AGTCTACCTCAATTTTTATTCAGACATTCTTAAAATATTTAATACACATTGTAAGAGTCT

327547 AGGATCTGTCTTTAGGCAGATAAGAGGAATTCAGAGAAAGCCTCTCCCTGCGTTTGCTGT
TTTTCAGGTACTTTCACCTCAGAATAATCAGTATACCAAAGTGGCATATTGAGATGGCAT
ATTTTGTTTCCTTGAGAGATGATACCTAGATGATACATAAAAACTTGAAAATACACGTAT
TTCAGTTATGCCCAACAACTAGCAGGATATGACACAGTGGCACAACGCTAACTTTTAAAG
TTAGAATACCAGCATTCAGAACTTGGCTTTTGAGTTACAAGCGGCGTGAACTTGAGAAAA
[G,A]
TCACTTAATTTCTGCAAGCTCATAAATTTCGGCTCCAGTTGAGCTTTCTAATTCTAGAGC
CCAAACCTTACTGATTGTATTTAAACATAGCTCCTGTTGTTTTTCTTTGAACCATCTCCA
TCTGAAAAACTGGAAAACCATTTTCACTTCAAAAAATTTTGTTGACACACAATAAAAAAT
TGTACTGAAAGTAGAAATCAGTACTAAGAATATGTTGCAAGAAGTCTACCTCAATTTTTA
TTCAGACATTCTTAAAATATTTAATACACATTGTAAGAGTCTATTAGAGCTATGACTCTC

329485 TCATATTGGAAAGAAGGACACCCTAAAAGAAAATAACATAAAAATATGCAAATCTCAATC
TCACTCATGATTGTATATAATAACCTACCATCAAAAGAATTTCTACATCACCTGAAAAGA
ATCACATCCAGATTATAAGATCCTTTAATATTTAAAAAAATTAAAAAACAGAAATATTAG
TATGTAAAAGTAATTAAATGTTATATCTGATAACATACAAATCACATTTATAAATTCAGT
GGGGGGACAGGTAGCAAAGACTTGTCATTTTACAAATTATTTGGATGGCTGCAATTTGAA
[A,G]
TGCAATCCTCACTGCCTATGGTATGTGTTTACAGAGTTCCTGCATCTTATTCTCCTTGTT
TGGACCTTAGAGTCTGCCAATTCTTGTACTCCTCCTGCCCCAGATTGCTTACCACATGTT
CCATAGATTTTGATTTTACTTGCCAGGAGTATATGCTAGAGTCAAACTGCTTGGATTCAA
GTCTAGATTTGAGCTTTGAACTTGAACAAATTACTCTGCCTTTATCTCAGTTAACAGACC
TGTAAAATGGATATCATAATTGAGCCTACAAAACTGAAGCTGTTTTGAGGATTAAGTGAG

338028 CATTTTTTAAAAAATTTTTATTTCTCTTGATTTTCCTAGTTTAAATTTTAAAATACCTTA
TTTACCTTTAGGAAATGACAACAGTTAAAAAAAAAAACATTTTAATGCATTGTGCTAACA
TCCTATTTCATGTTTATTTTACTACTTCTTATTTTTACAACGGGAAAATGTTTTAAATCA
TTTGTCATTGAAAGAATTTGACAATTCTCAATGAGTCTTGAAATTCTACTGCATAGGTTT
TTTATTTTGTGTCATACCACATTTATTGAAGGATTTATTTTTAAATATGAAGTTTTTTTA
[T,C]
TAGCTAAAATAAATAGAGAAAAATTATTTTGTATTTTTACAAAGTGTTTTGGGTGCAACG
TGTAGCTTAAGAGATAGCAAAATGCATCATATAATGAGTTGAGCACTTTCCAACTTCAAG
AATGTATTGGTTATAAAATTCTTGTCGCCAAAGTATCTAGTATTCATATTTACCTATGAA
TTTTTTCATAGAGTATTCTTAATATTTTTAAATTGGTCCATTCTCATGTATTAGCAAATT
TACCCCCAAATGACATACACACTGCCATATTTTTATTTGAAACTAAATGACTACCATATT

338256 CTGCATAGGTTTTTTATTTTGTGTCATACCACATTTATTGAAGGATTTATTTTTAAATAT
GAAGTTTTTTTACTAGCTAAAATAAATAGAGAAAAATTATTTTGTATTTTTACAAAGTGT
TTTGGGTGCAACGTGTAGCTTAAGAGATAGCAAAATGCATCATATAATGAGTTGAGCACT
TTCCAACTTCAAGAATGTATTGGTTATAAAATTCTTGTCGCCAAAGTATCTAGTATTCAT
ATTTACCTATGAATTTTTTCATAGAGTATTCTTAATATTTTTAAATTGGTCCATTCTCAT
[G,A]
TATTAGCAAATTTACCCCCAAATGACATACACACTGCCATATTTTTATTTGAAACTAAAT
GACTACCATATTATTTGATTGCTCCTTTTAAATTATACAATATTGCCATCCTATGAAAAA
TTATTTTAGAATAAAGTACTAATTTTAACTGACTTCTCTGTAGCTTTAGTAGTGTTGGTC
TTTCTCTCATTTTATAACCTCTGTCCTTGAATATTGAAGCCTGCATCCTAGTTTCCATGA
CAAAGTTTTCTTGATTTTATTCTATCCTTCCTTGACATTCTTTCTTAGTGTAGTTTTCTC

353678 ATGATGGAGTGTTGTTTGCATGCCCAACTTTATGGCTTCATAGGTTAGTTAACACCAAGT
TTATTATGAGCATCTCAAATTGCATGGTAAGTTGGTGGCCTGTGTTTAAGTGTTCGGTCT
CTACTAAGTCCCAACATTAGGCCAAAAGCTGTTTCTCAAAGGGGACTAATTATTTTTAGA
TGATGCAATGGTTTTGCTCTAAAATCCAAAGGGCCTGTACTACAGACCTGTAGGGACCTG
TTCTACCCTTCACCTGTAGGAACTTGCCAAAGGCTCTAAACAGCTTCCACTACCACTACC
[G,A]
CTGACACTTTAAGCACCATTGGATCTGCTTAATTGTATGGCTCATAGTGGAAGAGCAGCT
TGCACAGCAATCTGGATCTGTTGTAGAGTCTTCTCTTATTCTTGGCTCCACTCAAAATTA
GTGTTTTTCTGGTCACTTGGTAAATGGGTGAGAGTAACACAAATGAGGAGTATGTTGTCT
TCAAAA

FIGURE 3KKKKKKKKK

354509 GACAGTGAAGGTATATTGCTAGCTTTGCCAGCTGAAAGCACATTGCTTCTGGTGGCCCTT
ATTGATAGGGATTTAGACAAAGGCATTTGACAAATCAATAGCTGCATATCAGGTACAAGA
TGAAACCACATCTGCAGCAGCTGCAATTGGAGTCACTACCTGAATAAGCATATGATAATC
TACTGTCATTCTCTAGGATCTGTCTCTCTCCTGCACAGGTCAAATAGTCAAGTTGGTTGC
AGATGTGGTTGGAATCACCATTCCTCCATCTTTCAAGTTCTCAATGATGGCACTGACTGC
[-,T]
GCAGTCCCTCTGGGAATGTAGTATTGCTTCTGGTTTACAATTTTCCTAGGTAGAGACAAT
TCTAGTACCTTCCATTTGCCCTTTCCCAATGTAATAGATCTCACTCAACAGATAAGGGAA
CTACTGGGATTCTGCCACCAGCTGAGTATATCTGTTGCAATTATGTATTCCTGAACTGGG
GAAATAACCAAAGGATGGGATCAGGGATCCAGTGGACCAACTATGGGACAAAACTGAGCA
AGAACTCTATTTGCTGATATCCATAAGCCCCTACTCTAACTGGTAGACCATAGCCATGTG

359134 TTTGGCAGATATTTTAGCGTTTTTGAAGAATCTTTGGAAGAATGTTAAATACAGTGCCTG
GGCTACCATACACAGTTGTTTAGTTTGTGGACTGCATAACTCCAAAGGCCCCACATTCCT
CAGGATGGGCCAGATAATTCTGCAGTGACAAATGCACCCTAAATCAGGGCAGATTATCAT
AACAATGTTTTGTTTCTTTCTCATGCTGTATAAGTACTGCTGATCAGCTACTGCTCTGCT
ACATGTCACCTTCATGCCATACTTCTAGGCTAAAGAAGTGTCTCCTATTATCAATTTCTG
[T,G]
TCAGGGAAACAGGGAAAGGGAAACAGTGAAACATAATCAGACTCCTAAAGCTTTTAACCA
GAAATAATACAGGAACTTCAGCTTATATTTCATTGGACAAAGGAATTCAAATGACCACAA
TTCACCAAGGCATGGACATATAATCTTCCTACAAGATACACCGTGGAATATTGGCAGACA
TTAATGTGATCTACCAGAGGCACCATTCATATTCAATAAGACACAAATGACATCATTCAT
GTATGCAAAATGCTGTTGTGCCAGGAAGCATCTTTTCTGTTTATTTATATTAAAGCAATA

383690 TGTGTGAGAATATGCCAAATTTGACTATCTGTGTCTGGCTTATCTCATTTAACATAATGT
CCTGCAGTTCCATCTATGTTGTTGCAAGTGACAGAATCTCATTTTCTTTCACGGCTGACT
AGTATTCCACTGTGTATATGTACCACATTTTCTTTATCTATTCATCTGTTACCATTAACA
GATGAACACTTAGGTGGCTTCCAAATTGTGGAGTTTGCACGTAGTGCTGAGATAAATATG
GGAGTGCAGATATGTCTTAGATATACTGATTTCCCTTCTTTGGGGTATATATCTAGAAGT
[T,G]
GGATTGCTGGATCATATGGCTGTTCCATTTTTTAGTTTTTTGAGGCACTTCCAAACAGTT
CTCCATAGTCACTGTACTAATTTACATTCCTGCAAGAGCATATGAAGATTCCCTTTTCTC
TCCACCCTGACTAGTATTTGTTATTGCCTGTCTTTTGGATAAAAGTTATTTTAACTGGGG
TGAGATGATATCTTATTGTATTTTTGATTTGCATTTCTGTGATAATCAATGATGTTGAAC
ACCATTTTATATAACTATTTGCCACTCTATGGGTTTTTTTGTTTTTTATTTTGTTTTGTT

409005 ACATTATAGAAGACAATGAAATATGAAGACAAAAATAAGAATTTAGGATGACTCAAGCAG
TCTGATTTTTACTTTTGGTCAAGATGGAGTAACTTCTACTATCTGAGATAAGAAAACTCA
TTTAAAATATGTGGAAAAAAACATATTTAAGACATGAGACATCAGATAACCAAGAGATAG
TAATTAAAAGAGGAAAGCCCTACAATTTCCCCAACTTACTATTTAGGGTAAATTTTTAGG
CCCTGGCACAGGAGAAAGGACCCTGATAAAACCTTATAAACTCCTTAATGCACTATTAAT
[C,T]
GAGAAGACAGATCTGAGAGTTCAGGGAAATCAAGGTAGCAAGATTTCACAATGTCAGTAT
GACAGAGAAAAGGGCTTTCCAAAAGACAACTCCAGAGAGGTGCAGAGGTTCTCTGTGAGT
GCTCACTTAAATTTTACTAATAAAAAAAATTCAACAAAGAAGATAAAACAGATGGTAAAA
AGTATGTCACTTTTCTAAAAGAACATAGGAAAAGAGGAAAATAACAAAGACATGGGACAA
ATGCAAAGCAAATAGCAAGGTAGAATTAAACCTAAGAATATCAATAATCACATTAAATAT

409383 TCCAAAAGACAACTCCAGAGAGGTGCAGAGGTTCTCTGTGAGTGCTCACTTAAATTTTAC
TAATAAAAAAAATTCAACAAAGAAGATAAAACAGATGGTAAAAAGTATGTCACTTTTCTA
AAAGAACATAGGAAAAGAGGAAAATAACAAAGACATGGGACAAATGCAAAGCAAATAGCA
AGGTAGAATTAAACCTAAGAATATCAATAATCACATTAAATATAAATGATCTAAATACCC
CAATTAAATGGCATAGATTGTCAAATAGTAGTTTTTTACAAGACCGAGGTATGTGCTGCT
[-,G,T]
CCAAGAAACATACTTTAAATATAAAAATGAAAATACCCTAAAATGAAGAGGTATAAGAAA
ACTTCTGGGATTGACAGATATATTCGCTATCTTGATTGTGCCAAGTTTTCACAGTTGTGT
AGATATATCACAATATCCAATCATATGCTTTATTTGAAGTTTTGTGTATGCCAATTATAC
TTCAGTAAAACTGTGAGAAAATAATATGGTCCATGTAGGGAGTGGCAAGAAGTATAAAAT
TTCTGTAGCAGTGGAAGGTGATTTTGGAAAAATAGATGTGAGTCCATCTCTGAAGGAAAT

419889 ATGGGACCCATGTACAAAAAAATGGCCATGTTAGCACAACCCAAGGGTGGAGTTTTCAGC
CCTCTGATGTCAAAAGGTGAAGCAGAGGACGTAGAAACCCTCACTGAGCATACTCTGGAC
TGGCCAGAACTACTCCGTGGTTGGTGGTCTCTTATCAGGAAGGAAGCTGGTTAGTTGTTA
TGTCTAAACCACAGAAAGGGAGGGGCAGCATCAGATAGTTGATATCAGCGGTGGAGTGGG
TCTTTAAAAAGGGCTGGCTTCTCTTTAACCCTTGAAGAAGGAAGCTTAATGGTAGTAAAG
[G,C]
AGGGAGGTGTGTCCAGCCTCTCATCTCATCATCATAGTCGGGATCCCAGTTTTAAGGTTT
CTCTGGGGTAAGCTTGGCCATGAGGGGGTCTGTTCAATAGGTTGTGGAATTCGGATTTTA

FIGURE 3LLLLLLLLL

TTTAATTTTTATTTTTATAACAATAGTTTTTGGGGAACAGGTGGTGTTTGGTTGCATGGG
GGAAGTTCTTTTGTGGTGATTTCTGAGATTTTGGTGCACCCATCACTCGAGCAGTGTACA
CTGTACTCAATGTGTAGTCTTTTATCACTCACTACCCTCCCATCCTTCCCCACTGAGTTC

420071 TCTAAACCACAGAAAGGGAGGGGCAGCATCAGATAGTTGATATCAGCGGTGGAGTGGGTC
TTTAAAAAGGGCTGGCTTCTCTTTAACCCTTGAAGAAGGAAGCTTAATGGTAGTAAAGGA
GGGAGGTGTGTCCAGCCTCTCATCTCATCATCATAGTCGGGATCCCAGTTTTAAGGTTTC
TCTGGGGTAAGCTTGGCCATGAGGGGGTCTGTTCAATAGGTTGTGGAATTCGGATTTTAT
TTAATTTTTATTTTTATAACAATAGTTTTTGGGGAACAGGTGGTGTTTGGTTGCATGGGG
[-,G]
AAGTTCTTTTGTGGTGATTTCTGAGATTTTGGTGCACCCATCACTCGAGCAGTGTACACT
GTACTCAATGTGTAGTCTTTTATCACTCACTACCCTCCCATCCTTCCCCACTGAGTTCCC
AAATTCCATTATATCATTCTTATGTTGTTGCTCCTCATACCTTAGCCACCAGTTATGTGA
GAACATATGATGTTTGGTTTGCCATTCCTGAATTACTTCACTTAGAATAATGGTCTCCAA
CTCCAGGTTGCTGCAAATACCATTATTTTGTTCCTTTTTATTGCTGAGTAGCATTCTATG

433013 ACATCAGTCCACCAAAAGAGTCTTATTTGAGCAACAAACTGATTTTTGTGTGATATTTCA
TGGGACTAGAAGGATTGCATAGGACATATTTTGGGAAACACAGTTATGTTTAAAAACAAT
TTACATTAAAAACTTAAATGAAATAAAACAAACAAAAATCATAGCACACCTGGCCTCTGC
TACTCCGAGAGGAAGATTGGGACCTACCGGGACAGATGTTTTTCTGGTAAGGGAGAGTCT
ACCTTGCTATAAGTATCTCGTAAGTTTTACTGGTAGAGCACTGTTCCTTTATTCTTTAAG
[G,A,T]
TATAAAGTAGTAAATTCAAATTGAAGCAAAAGTAAAAGTGTTTTCTAGTTAAAAAAAAAA
AGCTAGTGGAAAATAAAATTGTAGCATAACTAATAGAAATTAAGTTGTAGTTTTTAGGTA
GTTTATTATATGATGGACTTGAAAAACAGCTAGTTTCAAATCAGAATAATTGCCTTTTTC
TTATGAAGTTAGTCTGGAGGGTGAAGACTGGAGATTGCTTTCTTTCTGTGTGAATTAGTT
GTTTCTTTTAAAGAAACAAAATCAACATAAGGAAATACCTGGGAGTTTTCAATACAGATG

439661 CTTTAGAAATAAATCTCCAGGAATGGTATTGTAAATATGTCACTTTGTGTTGTGCAGTGT
ATCTCTGAGAGAGATTCCAAAAAGCCAAAGTATAAATAAATACATAATTTTTGCCTTAAA
TCTTTAAGCTTCCCTTCATAAGAGTTGTATCATTTTGCATTACCACCAACAATGTGGTAA
AGTATTTTATCCTACAGCCTAGCCAACAGTGTCTTACCAAATTTTTGTACTTTTTTTGTG
CCAATCTGTTACGTGAGAAATGGCGTATCAATGTGTTTTAATTTGGATTTTATTTTTTCT
[-,G]
AATGATTGTTGACTTTTATGTCAAAAACTGCTGTTTTTTTAGAAATTAGAATACTTAAAA
AGTATTTTCTAAAAGGTGCAAAGAGAAGAATCTGAGAGATATATAGTTTAGTTATATGTT
AGAAGCTTAACACAGATTATTTTAATTTAGAATTATAATATATGGAAAAGTAAAATAGAC
ATGATTCTGAAAATAACTTCTAAAGTTAAATATTTTAACTTTGTTTAATGTCACAGAAAC
TATGCAAAAGAAATAATCCTCACATTCATAAACAATCATTTATTGCAGTTATAAAGCTTA

440875 ATATATGCATATATATGTATATATTGAGCATGTCGTTATACTATATTATTTTATTTTAAA
CCCTGTTCTTCTTTGGCCTAGCCTCATACCTTCTGTTTCTTTGAATCCTCTCTAACTTAC
TATTCTGCTTGTAAGTTATTGATTAATTTATCTTGTTTTGTGTCAGATTAAAGTAGAAGA
TGTAAGATGTTCATTTCTGTCATGACCTACTCTAGAGAGTTTTATAATATTGTAAGAAGA
AGTAACTTCTTCAATTTATTCAATTTATAGTTTGGTTGCTAATTGTTTCTAAAATTCAGA
[C,T]
GGGAAGAAATTTTAATATTGAATTACTATAACCTGAAGTGGGTTTTTGTAGCACATATCC
TTTGCCAGTGTGTTTAGAGTTACAGTCGGCTATAATTTGGAAAGTATTATTTAAGGGATA
AATAGAAATAGCATATAAATGAAACACTTTCTTTACATTCAGGTTAGCTATTTTATTTTA
TAAGCTAGCAAGATAAATTCAGTTGACAAATCCTTATTTATAATAATGGAACCCTTATTT
CCATTTTTGTCATACATTAGTATATTTCCCCATTATATACTTTATTCCCTTTATTATATT

453539 AAACGATCTGCAACAGATTTAGTATCCCAAGGACTTTTGATGCGTTAAAGAATCATACAC
AAAACAACTATGTTTGAAAAGTTTAAAAAATAATAAATGCAATCAGGAGATTGAGAAAAA
GATAAGAAGAATAAGCAGATTGGGGGAAATTAAACTTATAAAATTAAATATATAATTATA
AGAAAAAACTCAATAAATAGATACACAGTCATACACTATATATATTAATATTTATCAGTA
TATACTAATAAATGATACTAATAATTACTAATGAAAAGACATTTAAAAAAATCTAACAATA
[C,G]
TGGACTTCATTCTAAGAAAAAGAAAACAGAACAGAGAGCATACAATACTTATATGAATAA
TGGTTGTGAATTTTCTAGAAGGAAGTATAACATGTTCAAAATAGGAAAAATAACACATAT
CTAGAAACTTTATTACAGCTGCATAGTATAAAGGGGATAGAGAAAGGGGACATTTTAAAA
ATTAGGCATATAGAAGAAATCACTGACAAAAAAACATGACAACCAGACTTAAAGCAGCTG
TCTTACCACAATAGAAAGTAGACAGTTGAAAATAGTACCCTCACATTTTTCAACCCAGAA

453583 TTAAAGAATCATACACAAAACAACTATGTTTGAAAAGTTTAAAAAATAATAAATGCAATC
AGGAGATTGAGAAAAAGATAAGAAGAATAAGCAGATTGGGGGAAATTAAACTTATAAAAT
TAAATATATAATTATAAGAAAAAACTCAATAAATAGATACACAGTCATACACTATATATA
TTAATATTTATCAGTATATACTAATAAATGATACTAATAATTACTAATGAAAAGACATTT

FIGURE 3MMMMMMMMMM

AAAAAATCTAACAATACTGGACTTCATTCTAAGAAAAAGAAAACAGAACAGAGAGCATAC
[G,A]
ATACTTATATGAATAATGGTTGTGAATTTTCTAGAAGGAAGTATAACATGTTCAAAATAG
GAAAAATAACACATATCTAGAAACTTTATTACAGCTGCATAGTATAAAGGGGATAGAGAA
AGGGGACATTTTAAAAATTAGGCATATAGAAGAAATCACTGACAAAAAAACATGACAACC
AGACTTAAAGCAGCTGTCTTACCACAATAGAAAGTAGACAGTTGAAAATAGTACCCTCAC
ATTTTTCAACCCAGAATGATATATGCCAAACTATTTTTTCAAGAATAAGGGTAAAATATT

454909 TCAGGCACGGTGGCTTACGTCTGTAATCCCAGCACTTTGGGAGGCCGAGGTGGGTGGATC
ACCTGAGGCCAGCAGTTCAAGACCAGCCTGGCCAACATAGTGGAAACCCCTTCTCTACTG
AAAATACAAAAATCAGCCTGGTGTGGTGGCAGGCACCTGTAATCCCAGCTACTTGGGAGT
CTGAGGCAGGAGAATCGCTTGAACCTGGGAGGCGGAGGTTGCAGTGAGGTGAGATCTTGC
CACTACAATCCAGCCTGTGTGACAGAGTGAGACTCCCTCTCACACACACACACACACACA
[T,A]
GAATTTAACAGAAGGAATATAAAACAGTAAGTCCAGGGAAAGTAGGAGGAAAGAAATCAT
TACCACAAGAGCAAAAGTGAGAAAATAAAAAAACAAAGACAAAATAGAGAAAATCAACAA
AACCAAAAATTGAAAAAACTGATTGATTACATAAACCTTTAGAAAGATTGATCAAAATTT
AGGTTTCTAAATTCAAGAAAGAAGACACTTAGATGACTGAAGTAATTCAAGTTTCTAAAG
GCTGAGAAACTGGGAAGCCGCTAGAAATCAACACATGAAATAACCAAAATGAAGACAAGA

455341 GAAAAAACTGATTGATTACATAAACCTTTAGAAAGATTGATCAAAATTTAGGTTTCTAAA
TTCAAGAAAGAAGACACTTAGATGACTGAAGTAATTCAAGTTTCTAAAGGCTGAGAAACT
GGGAAGCCGCTAGAAATCAACACATGAAATAACCAAAATGAAGACAAGAAACTTCTGTGT
ACATTAAAGTAAAAAATGGGTTGTATTACCAAAAAAAACCTGATTTTTAGAATACAGAGG
AAAAGGAAAGGAAAAGCCTTCTGAAAAATGTCTTTTTTGTTAACTTTACATGCATTTTTC
[G,A]
TGGGTCAATTGATCAACACTAAATATTAAGTTTGAGAATCATTTGTTTATTTGTGTATTC
ATTCACTGCATGTGATAGATCTATGTGCCAATCTGGGTATTATAAACATCCATAAATCTC
TCATATATCATACTTCAAGTTATAATAATGTCACTCGTTCTCTGTGAACCCTTTGATACA
TCATTCCATTCAATAAACTGTTTATCCTTTGATTCTTAAAAAAAAAAAGATAAAAATTGA
CCAAAATAAAAGAAACAAGAAACTAAAAACTGGGAAGAAAAATGAAGATATAGTAACAAA

457421 CATTAAAAATGTATGGGCTATTCACTAGGTAATAGGTACTGGGTAATGTATATTGGTAGA
AAAAAAAAGAAACTAGATTCCCACCTCATATCATTCACAAATTTAAATCCAAGTGTTCTA
AGGACAAAATGTGATGGAAAGAACTTTAAAATTTTTGGAAGGAAAATAGAGAACAATTTC
CTTTCTCCTTGCAAGGAAAATATTTCACAAATGAAATGCATATTCTTACCTTAAAAGAAA
AATTGATAATTTTCATTATAGTCATTTTAAGAATAGTCTCTCAAAAAAAAAAAAAAAAAA
[A,-]
GAATAGTCTCTCAAAAAACTTTATTTAGATTGTCAAAAGACAAGACAAACTGGGAGAAGA
TATTTGCCATGCATACAATTAGTAAAGGAGTAGTATCCAAAATACATAAAGAAATCCTGT
AAAACTATTAGAAAAAGAACAACAAGCCAATTGAAAACCTTATGTAAGATCTGTATGTCA
ACCTAGGTAAGAAAATACACTCAACTTCATTAGTAATAGGGAAACTGCAATTCAACAAGA
ATACTTAAGTATCAAAATATATACACCCCCAACACTGGAGTACCCAGATTCATAAAACAG

457509 TATCATTCACAAATTTAAATCCAAGTGTTCTAAGGACAAAATGTGATGGAAAGAACTTTA
AAATTTTTGGAAGGAAAATAGAGAACAATTTCCTTTCTCCTTGCAAGGAAAATATTTCAC
AAATGAAATGCATATTCTTACCTTAAAAGAAAAATTGATAATTTTCATTATAGTCATTTT
AAGAATAGTCTCTCAAAAAAAAAAAAAAAAAAAGAATAGTCTCTCAAAAAACTTTATTTA
GATTGTCAAAAGACAAGACAAACTGGGAGAAGATATTTGCCATGCATACAATTAGTAAAG
[T,G]
AGTAGTATCCAAAATACATAAAGAAATCCTGTAAAACTATTAGAAAAAGAACAACAAGCC
AATTGAAAACCTTATGTAAGATCTGTATGTCAACCTAGGTAAGAAAATACACTCAACTTC
ATTAGTAATAGGGAAACTGCAATTCAACAAGAATACTTAAGTATCAAAATATATACACCC
CCAACACTGGAGTACCCAGATTCATAAAACAGGTTTTTAGAGACCTCTGAAGAGACTTAG
ATAATCACATAATAGTGGGAGATTTCAGTATTAGACTGATCATTGAAATAGAAAACTTGC

458009 ATTCATAAAACAGGTTTTTAGAGACCTCTGAAGAGACTTAGATAATCACATAATAGTGGG
AGATTTCAGTATTAGACTGATCATTGAAATAGAAAACTTGCAAAGATGTTTGAGACGTAA
AATCAGCACTTGACGAAATGGACCTAACAGGTATCTACAGAGCATCCACTGAACAACATA
CATTATTCTCAGCTGTACATAGCACATACTCTAAAATCAACCAGAAGTTCAGCCATAAAG
CAATTCTCAACAAATTACAAAATCAAAAAAGAAAACTCAGTCATATATCCCTGATGAACA
[T,C]
AGATGCAAAATTCCACAACAAAACATTAGCAGAGCAAACAAGTACCACATCAAATAACTA
ATCCACCATGATCCATTAGGCTTTATTCATGGGATGCAAGGTTGGTTCAACATACACAAA
TCAATGTGATTCAGTAAATAAAACTAAAAACAAAAACCACATGATCATCTCAGTAGGTGC
AGAAAAGGCTTTCAGTAAAATTCAACATCACTTCAAGTTAAAGACACTCAACAAACAAGG
CATTGAAGGAACATACCTGAAAATAATAAGTGTCATCTATGACAAAACCACAGCCAACAT

FIGURE 3NNNNNNNNNN

467295 ACGTTTATACTTTTAAAAGACCACCAGATAGTTCTTTTCATATTTTAAAAAGATCAACAG
ATGGACTTAGTTCAATTGTTGGTTAGCACAGGAATGAAGGGTTTTATTGCTGTCCACCTT
CAACATGGCAAACAGATAGCGGTACCTGCCAGATGTATAGTCCTTCTAAGCTCCTAAAAC
ATGCAATAATCAATGATTATTCCAAATCACTATTTTTTACTCTTGAATGTCAAAATGGTT
TCATTGTACCTATGACAGCTACATTTACAACTAGTCAACTGGTCTTATCTACAGAAACAG
[G,A]
CAACTGACTTAAGACTCAAGTTACTGGCTATATAAAGATACCTCAAGACGTTGATGTTAT
TCCCACATATAGATCTCAACTGCCACTTAATTACCTAAAGTGCCAGACCCCTGGGAATTT
TGCTGACTTATCCTACTAATTTTCTTGACATGGAATTAAAAGGTGGTGGTGTTCTGGGAG
ATTAATTTACTAAACAACAAATGCAATTCCATCCACTAACTCAAGGTATAGTTTATTATT
AAAATATTACTTCTTACTCAAAGTGACAAATGTTTTCAGCAACAACACAAATATCTATTT

468045 TGCTGTGTCTCAGTAATAAGATGAAAGGCTTATGTTCACCTGTCTTGTAAGTCACAGAAA
GAAGCACTGTTTCTTGAAATTCCAATCCAGTGCTCTTATTAATAAAGTGTATTAGTCTGT
TCTCATACTGCTATGAAGATACTACCCAAGACTGGGTAATTTATAAAGGAATGAGGTTTA
ATTGACTCACAGTTCCACATGGCTGGCAAGGCCTCAGGAAACTTACAATCATGTGTAAGG
CAAAGAAGAAGCAAGGACCTTTTTCCCATGGTGGGAAGAGAGAGAAGAGCCAGAAGCGAA
[T,G]
GGGTAAGAGCCCCTTATAAAACCACCATATGTCGTGAGAACTCACTCACTATCACGAGAA
CAGCATGTGGGAAACCACCCCCATGACCCAATCACCTCCCACTGGGTTTCTTCCTTGACA
TATGGGGATTATAGGGATTACAACAGGAGATGAGATTTGGGTGGACCACAGAGCCAAAC
CACATCATAAAGTCATTTAGTTTGCAATATAGAAGATCCTGTTAGAAACTATAAAAGAAT
TAGAAACCTCAGTTTAAAGCACTGTGAAGCTCATAGTCTTTTCATCTACGGCATAGATAT

468335 CAGAAGCGAATGGGTAAGAGCCCCTTATAAAACCACCATATGTCGTGAGAACTCACTCAC
TATCACGAGAACAGCATGTGGGAAACCACCCCCATGACCCAATCACCTCCCACTGGGTTT
CTTCCTTGACATATGGGGATTATAGGGATTACAACAGGAGATGAGATTTGGGTGGACCA
CAGAGCCAAACCACATCATAAAGTCATTTAGTTTGCAATATAGAAGATCCTGTTAGAAAC
TATAAAAGAATTAGAAACCTCAGTTTAAAGCACTGTGAAGCTCATAGTCTTTTCATCTAC
[G,A]
GCATAGATATCCTCCTAAACTCAGTATGGTGGTAAAAACTGAAATGGAAATGCAAATAAG
GAAAACTGGTTTGGCCTGTTCTCTACAATTTGCCTGTTCTCTATAGTTTGCCTTCATAGA
TGAGCACAGGTATGTAAGTTAATTGTTGTGATAAAAGAAATAAGAGTTTCGTTCTTCCTA
ATGAGTCTCTTACCTTACATAGTAAAAAGAGAAGTGAATATGTGTCTTGAGGTCATTAGT
GTTATTTGATGAAGACTCAAAATCTCATGAAATACTAACAAAATATAATCTTTTTAAACC

474258 GACCTTAAGGCATGAGCCTATCATTGCCCTGGAATAAATGCACCACCCATTGATAGTTAC
TCTTAAAAGAAAGAAACAATGCTACGTTACACACCTGCTGGATCCTGTAAAACAGTTTTA
CATATTATTTTGGTTTATCTTACAACAAGCTTGACCCTTTGATATAGGTATAACCTTTCC
AGTTTTCATAGATGAACTGACTACAACTAGGACTCTATTGGTCTCATTCTAGCACCAGTA
TTTTCAAAAGATCACACTTTAATAATTAGGCCATTTTCTCTAACAGTAAATATCACTATT
[A,T]
AAAGCAGTTCGTTATCTATATATGTTATCTATTTTATTAAAATCAATTACGAATGTTTAA
TTCCAGATCAATATTCCTCTATCATCAGTGTACTTCTGTGCCTTCTCCTACTACTGTTCA
ATATTTAATGTTCAGGAATGCATTAAATATTCATTTTAGGTGAAACAAGGTACACATTGG
TAGGAATATATGAAAATAGTCATGAATGCATTTCAAAGTGATTTGGGGTTATCTGTAATT
TTGGATTACTGGGAATAATCAAGAGTTGATTGTAGTAAATTATAGTAGTAGAATACTTAA

474259 ACCTTAAGGCATGAGCCTATCATTGCCCTGGAATAAATGCACCACCCATTGATAGTTACT
CTTAAAAGAAAGAAACAATGCTACGTTACACACCTGCTGGATCCTGTAAAACAGTTTTAC
ATATTATTTTGGTTTATCTTACAACAAGCTTGACCCTTTGATATAGGTATAACCTTTCCA
GTTTTCATAGATGAACTGACTACAACTAGGACTCTATTGGTCTCATTCTAGCACCAGTAT
TTTCAAAAGATCACACTTTAATAATTAGGCCATTTTCTCTAACAGTAAATATCACTATTA
[A,C]
AAGCAGTTCGTTATCTATATATGTTATCTATTTTATTAAAATCAATTACGAATGTTTAAT
TCCAGATCAATATTCCTCTATCATCAGTGTACTTCTGTGCCTTCTCCTACTACTGTTCAA
TATTTAATGTTCAGGAATGCATTAAATATTCATTTTAGGTGAAACAAGGTACACATTGGT
AGGAATATATGAAAATAGTCATGAATGCATTTCAAAGTGATTTGGGGTTATCTGTAATTT
TGGATTACTGGGAATAATCAAGAGTTGATTGTAGTAAATTATAGTAGTAGAATACTTAAT

481073 ATACCTTGTATGAAAACTTATGAAGTATAACTATAGCAGTACTTAGCATGAAATTTGTAA
GCTTAAATTATATATTTGAAAGAATGTGCTGATAATGAGTTAAGCATGAAGCATAAGAAG
TTAGAAGACAACATATCTAACAGAAAGTACAAAGAAGAAAGAAAATTTATAGTAAGAACA
GATATCAAATGTAATAGATTAAAAAAAATAGAGGGGAAAAAGCCAAAAATGTGTTCAAA
CCTCTGGAAAGCTTGATCATGAAAAAAAGAAATTATAAAAATAAATAATATTAAGAATGA
[G,T]
AAGAGGAATTTTATCACACATTCAGCAAAGATGAAAAACAGAACTTTATGAACAATGGAA
CGTGTTCCCTAGCTAAGTTGAAGATTTACGTGTCATACAGCTAGCAATGCCATCATGGTA

FIGURE 3OOOOOOOOO

CAAACTCCAGAAAAGCACGCCAACATACCCTATCTAAACATATTCAAAATTCAACCTGCC
AGGATGAAGAAAACATCTCAATGGCTCTGTGGCAAAGCCTGGTCGCTACCTGGTGACAAC
ACCTTTGAAATGGAGTTGATGCGTCAGCAGAAAGGCAACTGGCCAAAATTCTGGGACGAT

487013 GCGAAAATGACTTTGATTAAAACCTTGAAGAGATAAAATGTCTGAGAAGAACCTGAAAAT
AATATATTTGTGTAAACCTGATGTTTGAGAACATAGAATGGCTCCTAAGTCAATTTACAG
TCTAAGGGAAATTCATTTAAAGGATCATTAAAAAAAAAAAAAAAAACTGGTTAGCTTTAA
ATAGCATTTTCAAAGCCTGCTGTTTATACCCAGGAGAGAATTTCAATGAATAATGCCATA
GTAGCATATGGATAGGTTTCCCATAAATTCAAGGATATGATGATGTGAATCCCAATTGAC
[G,A]
GCATCCATCTTTTTCTCTCCGTACCCTCCTGGCTCTTCTTTAAATTTTATAGCCTTTGTT
TCTCAAGTAGTGCCTGAATTATTGTAATGTCAGCCTTATTATTAAGTTCTCTCTTGTGTA
TTCCACTTAATTGACTAACTTTATAATACATTCATAGAGATGAGGTATGGGTTGGAAAGG
AGTGATCTCATTTGATGATCTGGTTCAAATTTTTTAAAGTAAGCAAAATTAAGTAGTTTA
TAATTCAGTTCTTTTTAGCCATACTATTTTACTTTGTTCAACTTTGACTTTGCTAATGAC

487048 AAATGTCTGAGAAGAACCTGAAAATAATATATTTGTGTAAACCTGATGTTTGAGAACATA
GAATGGCTCCTAAGTCAATTTACAGTCTAAGGGAAATTCATTTAAAGGATCATTAAAAAA
AAAAAAAAAAACTGGTTAGCTTTAAATAGCATTTTCAAAGCCTGCTGTTTATACCCAGGA
GAGAATTTCAATGAATAATGCCATAGTAGCATATGGATAGGTTTCCCATAAATTCAAGGA
TATGATGATGTGAATCCCAATTGACGGCATCCATCTTTTTCTCTCCGTACCCTCCTGGCT
[C,G]
TTCTTTAAATTTTATAGCCTTTGTTTCTCAAGTAGTGCCTGAATTATTGTAATGTCAGCC
TTATTATTAAGTTCTCTCTTGTGTATTCCACTTAATTGACTAACTTTATAATACATTCAT
AGAGATGAGGTATGGGTTGGAAAGGAGTGATCTCATTTGATGATCTGGTTCAAATTTTTT
AAAGTAAGCAAAATTAAGTAGTTTATAATTCAGTTCTTTTTAGCCATACTATTTTACTTT
GTTCAACTTTGACTTTGCTAATGACCAAGGCAATAACATAATTATGAAATAATTCCTTTT

487580 TTTTACTTTGTTCAACTTTGACTTTGCTAATGACCAAGGCAATAACATAATTATGAAATA
ATTCCTTTTGAAAATCATAATGTTCTTGACTGGCTACTTGTGCTATAAACATAGTGGCAT
CTGAAGAAAAATTATGGCGACCCTCTTGCACTTAGAGACCAGTGCTTGGTTCTTTTTCAA
TATCAAAATATGCTAGTGGAGATTCTCTAACTGGCTGACAAATGCTAAGATTACTAATTA
TCACTGTTAGCATCATAAAATGAATCTACTTGAACTGGAGCTATTGGTTTCCCCTCTACC
[G,T]
AAATCTATAAAACAACCTTATTGCATATATGTATGTGGAGGTAGAGATATAGACAGATTG
ATAGATGGATCAAATTGACTGAAGATATTCACTCATATATAATCAGAAAATTATTTCCTT
GTATTTTAATGTTCGCATTTTATGTATTTTCTGATTTCTCGCTGGGCTAAGTGTACAGTT
AATATTATGTCCACTAACAGCATTTATTGAGTGCCTACTGTGTACTGGCCTTATTATTAG
GTACTGTACTTGATTGCCCCCTTCCTTCTTTAGAATAGATTTATCAAAACTGCAATAAAA

490479 ATTTCATATTTATGAGTCTACCCAGAGGAGGACAAATTCCAGTATATAAGACTTTAATTT
AAAGTAATCTCCAGTCAATAGCACACTTTCAACATTGGCAGCCATAGCCATCTAAATGCA
AACATCAGTGGGAAAGAGGAATTTTCTAGCAGTTAGGTTGTCTGAATATAAAGTGGCCTG
TCCTATAAGGTAGCGAAGGCCCCTCATAATAAGAATTTGTGCTGAAGCTAATTGGGAACC
TGTTTAGCATGTGGTAAAAGAAATCCCTGCTTTATTTAGGAGGTTGTGATACAAGTTTAA
[C,T]
GTAAGTTCAAACATTGAGATTTCATAACAACATATTTGTGAGTTCTAATTATGTTCCAAT
CACTTTTTTAAAATCTTTTCTGGTTACCAAAACATGTATAGCCTTTGCAGAAGATACTAT
TATGCCAATTTTACAGATCAAGAAAGTAAAGCATAATGAAGTATAGTAACTTAACAGTAC
CCACAGGTAGTAAGCATTGGAATGGGGTTATTATGGCATTAGGCCCTTTTCATACTAATG
CTTAGAACCAAAATTGAGTTCCCTTTCTACCCATTCAGTACTTTCACTTTTCTTTTTCAC

490531 TTTAATTTAAAGTAATCTCCAGTCAATAGCACACTTTCAACATTGGCAGCCATAGCCATC
TAAATGCAAACATCAGTGGGAAAGAGGAATTTTCTAGCAGTTAGGTTGTCTGAATATAAA
GTGGCCTGTCCTATAAGGTAGCGAAGGCCCCTCATAATAAGAATTTGTGCTGAAGCTAAT
TGGGAACCTGTTTAGCATGTGGTAAAAGAAATCCCTGCTTTATTTAGGAGGTTGTGATAC
AAGTTTAACGTAAGTTCAAACATTGAGATTTCATAACAACATATTTGTGAGTTCTAATTA
[T,C]
GTTCCAATCACTTTTTTAAAATCTTTTCTGGTTACCAAAACATGTATAGCCTTTGCAGAA
GATACTATTATGCCAATTTTACAGATCAAGAAAGTAAAGCATAATGAAGTATAGTAACTT
AACAGTACCCACAGGTAGTAAGCATTGGAATGGGGTTATTATGGCATTAGGCCCTTTTCA
TACTAATGCTTAGAACCAAAATTGAGTTCCCTTTCTACCCATTCAGTACTTTCACTTTTC
TTTTTCACCTTAGTCATTATTTATAATTTTCTACATGACTATTTTTTATTATTACCTCCA

491847 TGTGAATTTGTTCTCTTAGCAAATTTGAGGTAGGCACTACAGTGTTATTAACTATAGTCA
CCATGCTGTATATCAGATTCTTAGAACTTATTCATCTTATAACTGAAGACTTGTAGTCTT
TGACTAATATTTCCCCATTTCTTTCTCATTTTTATACCTCTTATATTGCTTTGCATGCAC
CTGGCAAGTAGAAGGCACTCAATGAATTTCATATGAATTAATATTATCCAATAAATACAC

FIGURE 3PPPPPPPPPP

AATACTCAGTATTTATAAATACTCAATATTGCTTCAAACACATGTATTTTATTAGTCTAC
[T,C]
TATATATTTTTAGTATTTTATTTTTGTTTATTTTGTACATATATTAATAACAAGCAATCT
GCTGAATGCTAAGGAAACAAAGGAGATAATATATGGTCTCTGTCCTCAGGAAGCTTATCA
CTAACCCACACTAGAGATAAGAGAGTTCCTGATTTATGTCATTCCCAAAGTCTGATTTTA
ATTTGACTTGATTTGAGATGGATTTTTTTTTCTATCAGCCATCATATAAATTGCTTGAAT
TTTTCTTTCAAGCTATTTGACTTTACAACCTTGAATTCTTAAAGAGAGCAAAAATGTTCC

495498 CAAGAAAATCTAGACATTAAGTTATCTGGGAAACTTAGTGAATTTAGATAGCTTAGGGGT
AATGGTGATATGTTAGCAAAGGAAAGTTGGACACCAAAACTGACATGCCATGCAAAGGCA
TTTGTCTCAGGCTCAGTAACATAGAGGTACATTCTAATTGGTGAAAGAAGAAATGCTACA
TTCAATTAGGCATCATAGGACTTGGTTTCTTGGCTCATGAGGATTCTCCTCTTTAGAACC
ATAAATGAAATAAAGCAAACATGCTATATTATCTTCCTTTGCTCTAAAAATGTGAAACTC
[T,A]
CCAGGTATTGGGACCTAAGGATGGCAATGTAGTTGATTTATGTTTTGGTTTCCTCATGGG
AAAACTAGAAATTTATTCATTTGTATGTAGAGTCATTCATTCAAAAATATTCTTGAGATC
CCATTCTGTACATACTCAGGCTATAGCAGAAATAGACAAAAATCCCTGCTGTCCTGGAGC
TTATATTCTAGAGAGATGAGAAAGACAATAAACAAACAATAAGCAAAACATTTTATATGC
AGAGATGTGGTGTGTTGCCTAGATTTCCCCTTCAGGACCCAACTAGTGGGAGTTCTGCCT

497751 TAAAACTATGGAGAACACATAAAACATGTTTTTTAATATGATAATTACTACCCTTCTTCT
GAGGGAAACTCCACTGAGTTCAGTATGATTTTTTGGACCATCCTGTGCCGTGAATCAGCT
GCTACTCCCCTACGTAAAGAAAAAAGGAAATAATTAAAAAGAAGAAGAATGTAATTCTGG
CAAAAGACCTTTTGTAGGACAGCCTCTGTGGAATCCTCCTCTGTTTTCAAATGGAAATGA
GAAGACTTATGTATCATAGCCACCTACTCCACTACAAATTTTTTAAAATTAAAATAATAG
[T,C]
CATCTCATGAATGTCCTTGCACAGAAATAAGCAACTTACCCGAAAACAAGCTTAGCTATA
TATTGAAAATGATATTTTTGGCTCAGAATAGGTATTAGGTATGTTATCACTTCTTGAATA
TAAACACAGAATATCTTGCTTGAAGAAGGATTTTACTTTTCAAATTATTGGATAGACACA
GTTTTGAAAATATTTGAACTTGAATAAAATCACATTTTGTTTACTGAGCATAATAACTGA
AAAGAAGGCTACTCCATTCTTTTCTAACTTATTCCAAGTTATCTGACAGACAAACAGAGC

504289 ATTTTTATCTCTTTTTCACAAACAATACACATATATTAATACCTATACTATGTATGGCTT
ATACTAATCCCTTGTTATATAGAAAGTTGAAACATATTATTCTGCCCTCAAGAGGCTTGT
AGTAGAGATGAGTCAAAAAACTGAAACTCTCAGGAAATGAATCATTTTGATAATTTAAGT
TTTTGGCCAGGGTTTAATCTTAGAAGTATTATTTTTATAACTTTAGAATAGTTTGGAGGC
AAACGTTTTTTAATCATGCATCCCCAAACTCTTGTCCTTTCAAATAAAATATATTGGACT
[T,C]
ATCTCAGTATTTTCTAATTAATATCGAATGATCATATGAAGGTATCGAGTTATAAAACAT
AGTGAATTATTTGATGCTCCTTGAATTTTGTAGGGCTATTTGATCCTAAACTCCTGGCTC
CTGACTAGTGTACACTTTGGAATCTTGTGTCAGATTTTCAGTTTTTCCACCTCTTCCATC
AGTCTGACTAGCAGTGTGCAATTATTTTCAACTCTCTCTTTGTAGATGCCTCCCCAACCT
ATCTTCTAATCTGTTGCCTACTACACTATTTTATGAACTTGGAAATCAATAAATATATGT

504315 ACACATATATTAATACCTATACTATGTATGGCTTATACTAATCCCTTGTTATATAGAAAG
TTGAAACATATTATTCTGCCCTCAAGAGGCTTGTAGTAGAGATGAGTCAAAAAACTGAAA
CTCTCAGGAAATGAATCATTTTGATAATTTAAGTTTTTGGCCAGGGTTTAATCTTAGAAG
TATTATTTTTATAACTTTAGAATAGTTTGGAGGCAAACGTTTTTTAATCATGCATCCCCA
AACTCTTGTCCTTTCAAATAAAATATATTGGACTTATCTCAGTATTTTCTAATTAATATC
[G,A]
AATGATCATATGAAGGTATCGAGTTATAAAACATAGTGAATTATTTGATGCTCCTTGAAT
TTTGTAGGGCTATTTGATCCTAAACTCCTGGCTCCTGACTAGTGTACACTTTGGAATCTT
GTGTCAGATTTTCAGTTTTTCCACCTCTTCCATCAGTCTGACTAGCAGTGTGCAATTATT
TTCAACTCTCTCTTTGTAGATGCCTCCCCAACCTATCTTCTAATCTGTTGCCTACTACAC
TATTTTATGAACTTGGAAATCAATAAATATATGTGAAGTAAAACTGTGAGGTATCAAAGC

515449 CCACCTCCACCTCCAAATTGCAAACTACTTCAGCAAGACAGTTTTTCTATTGTGAGACAC
TGAATTAACAAGAAAGGGATGTTCTCTAATTAACCACAGTGTAGAGATAATATGCAAGGC
AACTTAACTGTTTTATCTTTTATTTCAAATTGAGCAAAAGATAATAAAGGACATTTCAAT
CTATACCACCCTCCAGGAAAGGGAAAGGATTTAAGTGAGGAACTTTTATTTTTTATTATT
ATTTTTTAAGTATAATTAGAATTTTTCTTTTTTTTCTTTCTTTTTATTTATTTATTTTTT
[-,A,T]
TAGTATTTATTGATCATTCTTGGCTGTTTCTCGGAGAGGGGGATTTGGCAGGGTCATAGG
ACAATAGTGGAGGGAAGGTCAGCAGATAAACATGTGAACAAGGGTTCTCTGGTTTTCCTA
GGCAGAGGACCCTGCGGCCTTCCGCAGTGTTTGTGTCCCTGGGTACTTGAGATTAGGGAG
TGGTGATGACTCTTAACCAGCATGCTGCCTTCAAGCATCTGTTTAACAAAGCACATCTTG
CACCGCCCTTAATCCATTTAACCCTGAGTGGACACAGCACATGTTTCAGAGAGCAAGGGG

FIGURE 3QQQQQQQQQ

515451 ACCTCCACCTCCAAATTGCAAACTACTTCAGCAAGACAGTTTTTCTATTGTGAGACACTG
AATTAACAAGAAAGGGATGTTCTCTAATTAACCACAGTGTAGAGATAATATGCAAGGCAA
CTTAACTGTTTTATCTTTTATTTCAAATTGAGCAAAAGATAATAAAGGACATTTCAATCT
ATACCACCCTCCAGGAAAGGGAAAGGATTTAAGTGAGGAACTTTTATTTTTTATTATTAT
TTTTTAAGTATAATTAGAATTTTTCTTTTTTTTCTTTCTTTTTATTTATTTATTTTTTTT
[-,T,A]
GTATTTATTGATCATTCTTGGCTGTTTCTCGGAGAGGGGGATTTGGCAGGGTCATAGGAC
AATAGTGGAGGGAAGGTCAGCAGATAAACATGTGAACAAGGGTTCTCTGGTTTTCCTAGG
CAGAGGACCCTGCGGCCTTCCGCAGTGTTTGTGTCCCTGGGTACTTGAGATTAGGGAGTG
GTGATGACTCTTAACCAGCATGCTGCCTTCAAGCATCTGTTTAACAAAGCACATCTTGCA
CCGCCCTTAATCCATTTAACCCTGAGTGGACACAGCACATGTTTCAGAGAGCAAGGGGTT

515469 CAAACTACTTCAGCAAGACAGTTTTTCTATTGTGAGACACTGAATTAACAAGAAAGGGAT
GTTCTCTAATTAACCACAGTGTAGAGATAATATGCAAGGCAACTTAACTGTTTTATCTTT
TATTTCAAATTGAGCAAAAGATAATAAAGGACATTTCAATCTATACCACCCTCCAGGAAA
GGGAAAGGATTTAAGTGAGGAACTTTTATTTTTTATTATTATTTTTTAAGTATAATTAGA
ATTTTTCTTTTTTTTCTTTCTTTTTATTTATTTATTTTTTTTAGTATTTATTGATCATTC
[T,C]
TGGCTGTTTCTCGGAGAGGGGGATTTGGCAGGGTCATAGGACAATAGTGGAGGGAAGGTC
AGCAGATAAACATGTGAACAAGGGTTCTCTGGTTTTCCTAGGCAGAGGACCCTGCGGCCT
TCCGCAGTGTTTGTGTCCCTGGGTACTTGAGATTAGGGAGTGGTGATGACTCTTAACCAG
CATGCTGCCTTCAAGCATCTGTTTAACAAAGCACATCTTGCACCGCCCTTAATCCATTTA
ACCCTGAGTGGACACAGCACATGTTTCAGAGAGCAAGGGGTTGGGGGTAAGGTTATAGAT

515473 CTACTTCAGCAAGACAGTTTTTCTATTGTGAGACACTGAATTAACAAGAAAGGGATGTTC
TCTAATTAACCACAGTGTAGAGATAATATGCAAGGCAACTTAACTGTTTTATCTTTTATT
TCAAATTGAGCAAAAGATAATAAAGGACATTTCAATCTATACCACCCTCCAGGAAAGGGA
AAGGATTTAAGTGAGGAACTTTTATTTTTTATTATTATTTTTTAAGTATAATTAGAATTT
TTCTTTTTTTTCTTTCTTTTTATTTATTTATTTTTTTTAGTATTTATTGATCATTCTTGG
[C,G]
TGTTTCTCGGAGAGGGGGATTTGGCAGGGTCATAGGACAATAGTGGAGGGAAGGTCAGCA
GATAAACATGTGAACAAGGGTTCTCTGGTTTTCCTAGGCAGAGGACCCTGCGGCCTTCCG
CAGTGTTTGTGTCCCTGGGTACTTGAGATTAGGGAGTGGTGATGACTCTTAACCAGCATG
CTGCCTTCAAGCATCTGTTTAACAAAGCACATCTTGCACCGCCCTTAATCCATTTAACCC
TGAGTGGACACAGCACATGTTTCAGAGAGCAAGGGGTTGGGGGTAAGGTTATAGATTAAC

515555 ATAATATGCAAGGCAACTTAACTGTTTTATCTTTTATTTCAAATTGAGCAAAAGATAATA
AAGGACATTTCAATCTATACCACCCTCCAGGAAAGGGAAAGGATTTAAGTGAGGAACTTT
TATTTTTTATTATTATTTTTTAAGTATAATTAGAATTTTTCTTTTTTTTCTTTCTTTTTA
TTTATTTATTTTTTTTAGTATTTATTGATCATTCTTGGCTGTTTCTCGGAGAGGGGGATT
TGGCAGGGTCATAGGACAATAGTGGAGGGAAGGTCAGCAGATAAACATGTGAACAAGGGT
[T,-]
CTCTGGTTTTCCTAGGCAGAGGACCCTGCGGCCTTCCGCAGTGTTTGTGTCCCTGGGTAC
TTGAGATTAGGGAGTGGTGATGACTCTTAACCAGCATGCTGCCTTCAAGCATCTGTTTAA
CAAAGCACATCTTGCACCGCCCTTAATCCATTTAACCCTGAGTGGACACAGCACATGTTT
CAGAGAGCAAGGGGTTGGGGGTAAGGTTATAGATTAACAGCATCCCAAGGCAGAAGAATT
TTTCTTAGTACAGAACAAAATGGAGTCTCCTATGTCTAATTCTTTCTACACAGACACAGT

515887 CCTTCCGCAGTGTTTGTGTCCCTGGGTACTTGAGATTAGGGAGTGGTGATGACTCTTAAC
CAGCATGCTGCCTTCAAGCATCTGTTTAACAAAGCACATCTTGCACCGCCCTTAATCCAT
TTAACCCTGAGTGGACACAGCACATGTTTCAGAGAGCAAGGGGTTGGGGGTAAGGTTATA
GATTAACAGCATCCCAAGGCAGAAGAATTTTTCTTAGTACAGAACAAAATGGAGTCTCCT
ATGTCTAATTCTTTCTACACAGACACAGTAACAATCTGATCTCTCTTTCTTTTCCCCACA
[A,C,T]
TTCCCCCTTTTCTATTTGACAAAACCGCCATCGTCATCATGGCCCGTTCTCAATGAGCTG
TTGGGTACACCTCCCAGACGGGGTGGCGGCCGGGCAGAGGGGCTCCTCACTTCCCAGATG
GGGCGGCTGCCGAGCGGAGGGACTCCTCACTTCTCAGATGGGGCGGCCGGGCAGAGGCGC
TCCTCATATCCCAGACGGGGTGGCAGAGCAGAGGCGCTCCCCACATCTCAGACAATGGGC
GGCCGGGCAAAGACGCTCCTCACTTCCTAGACGGGATGGCGGCCGGGAAGAGGCGCTCCT

517766 CTAGCATAATATTATCAACATGACCACAGATCTGATTAGATATCACTAATAATTAGTAGT
GGCTACTAGGTTTGAGGTTATAGAACTCAGTCTGAAATCACAAATTCTACTAAGTTGTTA
TGAAAATATCATATGGAATATAAAATAGAGGTACAAACTATCTGTTCTCATTTTCTTCAA
TGGATGCTTTGAGAAGTCAAGGAAAGCATGACATGTTAAAATTAGTGTCAGGTCTGGGTA
TACCTGGAAATATGCTTTTCTGGTGCTAATTTGAGAAATATTAATTTTCTCACGGTCCAT
[G,A]
TGCAGCACTAAGAAGACAGAAGACAAAATGTGTAAATGAAGGCAATGGGCATAGAAGGAC
TAAGGAAGCAAATTGCTGCTAATATTGGGCATTTCAGCACCTCCTCTAAACTTTATTACC

FIGURE 3RRRRRRRRR

TTTTGTTTGTTTGTTTTTGATTTTTTTGTTTATATGTTTTGCAAGGAGAGTCAAACAACA
GTTAACGCTGGGTATTATAAGACTTTCAAAATCTAAGAAGCAACAAAACCAAATACCATC
CACTCTGCCACAAATTTCACATTGGTCTTTTAATCCCTACTAGTTTGTATTCAATAAAGG

519095 TGCCTCATTTTCCCCATTCCCCAAGCTAGAGCAGATGTGGAATGTTTTGGAAGCATAGTG
AATGAGTGAGCTGATTAAACATTTTATAGAAATATGAGACATGTGTTTTCTGGAACCTGT
CAGCTCACTTTCTAGAAATCCACCAGGTCATTCTACATTAACAGTGAGGTAAATAAATTT
TTGACCCTCGTAGTCAAAGCTTTAATATGGGACAGGAAGAAAAGAGAGACTTTAAATCAT
TATCAAGACTGACTACTTCAGTATGTCATTTCCGGTTTTAAATGTTCACAAGATATAGAC
[C,T]
ACTGAGATACTCAAACTAAATCAATCGTTTTGTTATTGTTGTTGCAGTGCGCTTCCCGGG
AATTAAAACTTACATTGATCCAGATACATATGAAGACCCATCCCTAGCAGTCCATGAATT
TGCAAAGGAGATTGATCCCTCAAGAATTCGTATTGAGAGAGTCATTGGGGCAGGTAAATG
TCAAATCTACACTTTTGAACAAAACATTCCTTAATTTCTTTGTAACTGGTTTATCAACAT
ACTATCTTAAATCTTGGCAGTTTTGGTCATTGAAAAGTTTTAACAAGTGAGAAGTAAAGT

520168 ATACAGATTTATTCCTCTTTCAGATGCTTGACCCAAGGTGAATAGTCCATGCTGGCAGAG
GAGCTGTCATTCAGGGGGACTTGCAAGGCCCAAGTTCCTTCTGTTCTTGGCTCTTCCTTC
CCCTAGCATGCCATCCTCCTGTAAATGACCAAAGCTGGGTCACCAGTACATCTGCCTTCC
TGACTGTGAGAAGGAAAAGGAAATAGTTCTGTCTCTCTGGTTTTGCTTTTAAGGCAATCA
CCTGAAACTTCCAAACACAGTATTCACATCTCAATGGTCCAAATAACAATAACATGGACA
[T,C]
ACTTAATTGCTAGAGAGTTTGGAAACGGAATTGCCGACAGCTGCCATGCATGCAGCTAAA
ATGCATACATTTATGCAGGGGGGCTGTTTTCCTAAAATAGACAAGGGATATTGGATCTTG
ATGGGGAACATAGGTCTCCTCTAGATGCTGGAGATTTGTTTAATCCTTTGGAAAGAGCAG
AACAGATGCAAGCATGGCCATTCCAGCCAGGTGTCATGTCTTTACAAAGGCCAAAAGAAA
GCAGCTGATGATCCTCTGTTTCTTTCAAAGTCCTTTTTCCTCCAGAAGGACAAGCTACAT

520908 TTACATACTCATGAAGCTAATCCTGTTTCCCGGGTACACAGAGAAGTAGAACTACCTCAA
GAATTCCAGGCACATTTGCAGAGAGTTCTTCCTGATTTCACTCCATTCCCTAGGTACCAT
AGATCACCTCATCTCCTGCATGGCTGGGTCTCCCTCTGAAAGCTGCCACAAGGGCCTTTA
TGTTCATAATCTTTATGTTCTCAGCCAAAGAAGCTGCCTTATCAGAAAGATTAAGGACCT
GAAATGGAACCAGATTCTCTGTCTTCTTCCACTGAACAAAGAGCACATCAGCAGGCATAA
[C,T]
TGAGAAGAGTGATTGAATTATATTCATTTAGCTTTGGAGTTTGTTTTCTTAAGACAGCAA
AGGGATAGAGAAGAGAGGAGGTTGGATAATCTCCATTGCACACGATGTTTGGCTTTCTTC
TTCTTGCACCTGTGAAAAACTGATATGTCTTTTTATACTGCCTTGTCCAATACTCACATA
GATACAGGAGAAGCATTTTCTGTTTTAGCCCTTTGTGCTACAGCATAACAAAATGCCAGT
GTCTGAAATCATAATGTTGAGAGATAAAATCAAGTATTGAAGTATAAACAATAAGAAGAA

521734 TCTCTTTTTAAATCTTTATTCATCTTTGATTGTTTCAGCTTTCAAACAATATGCTAAGGG
TCCTTTTACTGTCCATATTCAGAAAAATAACAAAAATAAAACTGGTATGTGAGACAAAAG
TATTATAACCTAACTTGCGCCCCTGGCCGTACTGCTCTGTTAATTTATTCCTTTAGATCA
TTGTTATAGCCCTTTTTATGCTGCTCTAATAGAATGCCTCACATGGGGTAGTTTATAATG
AACAGAGTTTTTAGGCTCAAGGTCCTGGCGGCTGAAGTCAAGATTGAGGGGCCACATCTG
[C,G]
TGAGGGTCTTCCTGCTGCATCATAACATGGTGGAAGGCATCACATGGGTGAGGGAGAGAA
AAAGGGGGCTGACCTCTCCCTTTTATGAGGCTGCTGCATTAATCCAGTCATGAGGGCTGA
GCCCTCATGATCTAATTACCTCTTTAAGGTCCCACCTCTAAACACAGTTGTATTAAGGAT
TAAGTTTCCAGTGTGTGCACTTGAGGGGACACATTCAAACCATAGCAGTCATGTTTCTAA
AACTTTACTTTTGTGACTGTGTGAAGTGTGAACGTATTCCATAGCAGCAGTGTGGACAAA

524170 TATATATATATTTTAAAACCTTGTGTTTATGGCTCATTTTCTCTATATTTAGATGAGATG
ACTTCCTTAGAAATGAGATTCATTCTTGTCCATCAACTTAAAGGATTTATGGTAGAGGTC
ACATTCATTTTCTTGTGTATTCTTGAAAACTTTGCATGTTGAGTAGACTGAGAATAAGAT
CAACAACAGATTTTGGCAAGGCCTTTGTGCTTTTACTCAATAATTTCAGAGCTTTCTAAA
TCAAATGATGTAATAAAAGATCAGCTTTACCCATTCTCCATCTATATTATGATATGAATG
[A,G]
AAAAGCAAAGAATGAAGCAAGACAGACTCAGATATGAATCACAGCTTTGCTACTAGCTCA
TTCTGTAAACTTTAACAATTTAGTTATCGTTCAGAAATTTGGGTCACTCCATGTATAAAG
TAGATTTATAATAACAGCTATCTTACAGGATTAATAAAAGGATTAGAAATGACTATTAGA
TTAAAAAATAAATACAGTTTCTACATTCAGTTTTGACTGCTGAGATGAATAACACTTATT
GCCCAACCCTCAATATACTTTGTGATACGAATATCTGCCCATGCAGAATTCAACAGTCAA

524245 AGATTCATTCTTGTCCATCAACTTAAAGGATTTATGGTAGAGGTCACATTCATTTTCTTG
TGTATTCTTGAAAACTTTGCATGTTGAGTAGACTGAGAATAAGATCAACAACAGATTTTG
GCAAGGCCTTTGTGCTTTTACTCAATAATTTCAGAGCTTTCTAAATCAAATGATGTAATA
AAAGATCAGCTTTACCCATTCTCCATCTATATTATGATATGAATGAAAAAGCAAAGAATG

FIGURE 3SSSSSSSSSS

AAGCAAGACAGACTCAGATATGAATCACAGCTTTGCTACTAGCTCATTCTGTAAACTTTA
[A,G]
CAATTTAGTTATCGTTCAGAAATTTGGGTCACTCCATGTATAAAGTAGATTTATAATAAC
AGCTATCTTACAGGATTAATAAAAGGATTAGAAATGACTATTAGATTAAAAAATAAATAC
AGTTTCTACATTCAGTTTTGACTGCTGAGATGAATAACACTTATTGCCCAACCCTCAATA
TACTTTGTGATACGAATATCTGCCCATGCAGAATTCAACAGTCAATGCCTTAGGTAACTG
GAATAATATTTATGATTTTCAGAGTTAGTTGAAAATTAGTAATTGAAATGAAATTTTATT

524302 TTGTGTATTCTTGAAAACTTTGCATGTTGAGTAGACTGAGAATAAGATCAACAACAGATT
TTGGCAAGGCCTTTGTGCTTTTACTCAATAATTTCAGAGCTTTCTAAATCAAATGATGTA
ATAAAAGATCAGCTTTACCCATTCTCCATCTATATTATGATATGAATGAAAAAGCAAAGA
ATGAAGCAAGACAGACTCAGATATGAATCACAGCTTTGCTACTAGCTCATTCTGTAAACT
TTAACAATTTAGTTATCGTTCAGAAATTTGGGTCACTCCATGTATAAAGTAGATTTATAA
[T,C]
AACAGCTATCTTACAGGATTAATAAAAGGATTAGAAATGACTATTAGATTAAAAAATAAA
TACAGTTTCTACATTCAGTTTTGACTGCTGAGATGAATAACACTTATTGCCCAACCCTCA
ATATACTTTGTGATACGAATATCTGCCCATGCAGAATTCAACAGTCAATGCCTTAGGTAA
CTGGAATAATATTTATGATTTTCAGAGTTAGTTGAAAATTAGTAATTGAAATGAAATTTT
ATTTTTGTTACTACATTGAGTTATATCCATGTCAACAAACTCTTTTTCTTTTTAATTAAA

524438 ACCCATTCTCCATCTATATTATGATATGAATGAAAAAGCAAAGAATGAAGCAAGACAGAC
TCAGATATGAATCACAGCTTTGCTACTAGCTCATTCTGTAAACTTTAACAATTTAGTTAT
CGTTCAGAAATTTGGGTCACTCCATGTATAAAGTAGATTTATAATAACAGCTATCTTACA
GGATTAATAAAAGGATTAGAAATGACTATTAGATTAAAAAATAAATACAGTTTCTACATT
CAGTTTTGACTGCTGAGATGAATAACACTTATTGCCCAACCCTCAATATACTTTGTGATA
[C,T]
GAATATCTGCCCATGCAGAATTCAACAGTCAATGCCTTAGGTAACTGGAATAATATTTAT
GATTTTCAGAGTTAGTTGAAAATTAGTAATTGAAATGAAATTTTATTTTTGTTACTACAT
TGAGTTATATCCATGTCAACAAACTCTTTTTCTTTTTAATTAAAGAAACTCAAGGCAGGG
CACGGTGACTCACGCCTGTAATCCCAGCATGTTGGGAGGCCCAGGCGGGTGGATCACGAG
GTCAGGAGATCAAGACAATCTTGGCTAACACGGTGAAACCCTGTCTCTACTAAAAAACAC

525518 TTTTCTATCTTATATACAGATTTCCAAAACTTGCAAGTTGCCTCATCATAGTCATTGTTT
GATAAATGCTTGTTTAATAAATAAATAAAATTCTTAAACTAATTTAAAAAAATAATGAGT
AAATAAATGAATGACAAAAGGATATAGAATTATTCTAAGTAATGATTTTACGTGACTATG
TTTATCTGGTTGCCAACAAAAATCTTAATGAAGTATGACAATATAAAATTAATTGCATAA
TATGTGCAAATAAAAATAAGAAAAATTCATAGAGGACATTTGGGAATTACAATTGTTACA
[T,A]
TGCTTTATATTAACAATTTACTTGATAGACCAAAATTATAGAATTTATTATATGCCTTTG
CACTTATATAGTAAAATACAGAATTATACAGAAAATATTACATTGATATTTTATTTTGAA
TTGAGTTTATGTAACAGGGGAAGTAATTTTGAAGAGTTGTTTATAACTTACAAAGAAGTT
ATTTTTCAAATTTGTTTTTATTTTTTTCTTCTAGTTTGTGTATTGCTAAAATATTAGGTG
AAATGAAGGAAATTTGATCCCTATTTTCAAAAGAGTTCTCCAAGGATGTTAGCAAGACTG

525847 ACCAAAATTATAGAATTTATTATATGCCTTTGCACTTATATAGTAAAATACAGAATTATA
CAGAAAATATTACATTGATATTTTATTTTGAATTGAGTTTATGTAACAGGGGAAGTAATT
TTGAAGAGTTGTTTATAACTTACAAAGAAGTTATTTTTCAAATTTGTTTTTATTTTTTTC
TTCTAGTTTGTGTATTGCTAAAATATTAGGTGAAATGAAGGAAATTTGATCCCTATTTTC
AAAAGAGTTCTCCAAGGATGTTAGCAAGACTGGGTACATCTTAGAATGATGTTCTTTCTT
[A,G]
TGGCTAAGAAACAATAGATGAGAAAGACCCACATATCGACAGCAACAACTTTTAGCCCTT
ATATTTCTAGAGTATATTAGTTATCTCTTGCTGCACAACAAATTACCCTAAAACTTAAAA
CAGGAACATTACTATCTCACAGTGTCAGTGGCTCAGGATTCAGGAATGGCTTAGCTCCTG
CACAGTTGCTCACAAGGTTGCAGTCCTGGTGTCAGCTGGGACTGTGGTCTCAACTGAAGG
TCAGCTGGGCAAGGATCCACATCCAAACTTATTTATATAGCTGCTGTCAGGATACAGTCC

527994 GGAAAAGCATTAGAAGTGGTAGAATAAATGGTGTGGAGATTAAGAGGAATTTAGGACGTT
TTCAAGTATTTAGAGCTTGATGACACTGGGATCTTTATTATATCTAATTTCTCTTCAAAA
CATAAGCTTTTCCTTTTTTTTTTTTTTTTTTGATGTGAATGTAACTCTAGCCCTGCTTTTT
GGCTATGAATAATGGCTAGTGACTTTTTAGTTTGTTGACTTTTTAATGACAAAGTTTAAA
GTGATTAAAGAAAAGAGGAAAGATGTTTTACTTTTATTGGGCAAAGAAAAGTAAAAAAGA
[C,-,G]
TATGGATCTGTATGTGTGTGTGTATGTATACATACGTACATGTAAATGTGTTTGTGTTTG
TATGTGTGTGTGTGTGTATACATACGTACATGTAAATGTGTTTGTGTTTGTATGTGTGTG
TGTGTATGTGTGTATTAGTCAGCTTCACTGTCATAACAAAATATCACAGATTGGGTGGCT
TAAAAGGCACAAATTTATTTTCTCACAGTTCTGGAGGCTGGAGTTTTAGATGGGGTGCCT
ACATGGTCAGGTTCTGGAGAAGCTGTCTTCTGGATCGCAGAGATCCACCTCCTTGTCCTC

FIGURE 3TTTTTTTTTT

528084 ATCTTTATTATATCTAATTTCTCTTCAAAACATAAGCTTTTCCTTTTTTTTTTTTTTTTT
GATGTGAATGTAACTCTAGCCCTGCTTTTTGGCTATGAATAATGGCTAGTGACTTTTTAG
TTTGTTGACTTTTTAATGACAAAGTTTAAAGTGATTAAAGAAAAGAGGAAAGATGTTTTA
CTTTTATTGGGCAAAGAAAAGTAAAAAAGAGTATGGATCTGTATGTGTGTGTGTATGTAT
ACATACGTACATGTAAATGTGTTTGTGTTTGTATGTGTGTGTGTGTGTATACATACGTAC
[G,A]
TGTAAATGTGTTTGTGTTTGTATGTGTGTGTGTGTATGTGTGTATTAGTCAGCTTCACTG
TCATAACAAAATATCACAGATTGGGTGGCTTAAAAGGCACAAATTTATTTTCTCACAGTT
CTGGAGGCTGGAGTTTTAGATGGGGTGCCTACATGGTCAGGTTCTGGAGAAGCTGTCTTC
TGGATCGCAGAGATCCACCTCCTTGTCCTCACATGGCAGAGAAGAGATATATCTTCCTCT
TCGTATAAGATCACAGTCTTTATCAGATTAGGGTCCCGCTCTGAAAACCTCATTTAGCCT

529495 GTGACACTTTCTAACCTGTCTCGTCTTTACCTGATCTTGTCCCTAAAATTTGGAGTCATT
TTATATTTGTTCTTCAAACATCTCATCCACTGGGGGAGAAAATTCAATTTAAATTTTGAG
AACAAGAACTAGCCAATTTACCTTCGTGAGCTGTAATTTCCCTATCCGTGAAATAAAAGT
AAAATACCTTTACTCCTTCATGATTGTTGTGAGAAGAAAATGAGATAAAGTAGATTCTAT
CTGACCATCCAGCATTTATCAGAACACCACCAGTGAAAGTGTTCACTACCTCCAAGATAG
[C,A]
CCATTCCCTTGGGAACAGTTCCAATAAATCCAGGATATTTGTGAGTAAAAAAAAAAAGTG
CTTCCTTATAACTCCGTACATGATCTTACAACACTGCCTACTGGTACTCGTTCTGCAAAA
TTGAACTTATACAAAGTAAACCTAATCCTACTTCCACACCACACCATTACCCTTCAAATA
GTTAAAGAACAACATGTAAACCTCATAAATCTTCTTTGTTCAGCCTAAATTGTCTAAATC
TTTTCAACCATTTCCATCCGACATGATGTCTAGATACGTCATCATTCTGGCCACCTTCCT

530226 GCATTTGCTTTTTGAACAGCTGCCACGCGCTGTTGGCATAGGGAGAGCTTACTACCAGCT
TATCCCCAGCGGTCTTTCTCAGAGGAGTTTCTATTAAGCCAGGCCTATTTCTATACTTGT
CAATTGACTTTATTACTTTTGAGTGCAATATTATATTTTTATAGGTCTACACTATATATA
TATGTAAATCATATATATAAATATGAACCATATATATCATATAATTCATATATAAAAATA
TGAATAGATATAGATATGTTGAAAATGGTCTAGATATGTAATACCTATATAAATTTGTAT
[A,G]
GATAGGTAAAGAATGTATATTCTAGAAATATATACTAGAATATATGATATATTCTTTACA
TGTCTATACAAATTCTAGTATATATAGAATATATGATATGGAATATATGGTATATGTACT
TTACATCTCTATACAAACATTATGTACTTTTCATATTCCCATTTCATAAATATTCCTATT
CAATTTCATTGTGTTTCTGTAAGTAAAATTTCTCAACCTGTCCATGTCTTTTTCCATCTC
AATTACATCAGCTGGTACAATTATTGTCCTTCTCAGTAACATCTGTGATTTGTTCTGCCT

530326 AGGCCTATTTCTATACTTGTCAATTGACTTTATTACTTTTGAGTGCAATATTATATTTTT
ATAGGTCTACACTATATATATATGTAAATCATATATATAAATATGAACCATATATATCAT
ATAATTCATATATAAAAATATGAATAGATATAGATATGTTGAAAATGGTCTAGATATGTA
ATACCTATATAAATTTGTATAGATAGGTAAAGAATGTATATTCTAGAAATATATACTAGA
ATATATGATATATTCTTTACATGTCTATACAAATTCTAGTATATATAGAATATATGATAT
[G,A]
GAATATATGGTATATGTACTTTACATCTCTATACAAACATTATGTACTTTTCATATTCCC
ATTTCATAAATATTCCTATTCAATTTCATTGTGTTTCTGTAAGTAAAATTTCTCAACCTG
TCCATGTCTTTTTCCATCTCAATTACATCAGCTGGTACAATTATTGTCCTTCTCAGTAAC
ATCTGTGATTTGTTCTGCCTTGCAATTTAGCTGTGTACTCTTATCATAAGAGCTCAGCAC
TCCCTGTGCAGCAATCATTTAGTATACTCTCTAATTTTCTTCTTCATTGGTACAATTGTT

530372 AATATTATATTTTTATAGGTCTACACTATATATATATGTAAATCATATATATAAATATGA
ACCATATATATCATATAATTCATATATAAAAATATGAATAGATATAGATATGTTGAAAAT
GGTCTAGATATGTAATACCTATATAAATTTGTATAGATAGGTAAAGAATGTATATTCTAG
AAATATATACTAGAATATATGATATATTCTTTACATGTCTATACAAATTCTAGTATATAT
AGAATATATGATATGGAATATATGGTATATGTACTTTACATCTCTATACAAACATTATGT
[A,G]
CTTTTCATATTCCCATTTCATAAATATTCCTATTCAATTTCATTGTGTTTCTGTAAGTAA
AATTTCTCAACCTGTCCATGTCTTTTTCCATCTCAATTACATCAGCTGGTACAATTATTG
TCCTTCTCAGTAACATCTGTGATTTGTTCTGCCTTGCAATTTAGCTGTGTACTCTTATCA
TAAGAGCTCAGCACTCCCTGTGCAGCAATCATTTAGTATACTCTCTAATTTTCTTCTTCA
TTGGTACAATTGTTTTTTCATTATTGGAATTCTGTATTTTGTAGTTGCCTATCTCTCACT

530407 ATGTAAATCATATATATAAATATGAACCATATATATCATATAATTCATATATAAAAATAT
GAATAGATATAGATATGTTGAAAATGGTCTAGATATGTAATACCTATATAAATTTGTATA
GATAGGTAAAGAATGTATATTCTAGAAATATATACTAGAATATATGATATATTCTTTACA
TGTCTATACAAATTCTAGTATATATAGAATATATGATATGGAATATATGGTATATGTACT
TTACATCTCTATACAAACATTATGTACTTTTCATATTCCCATTTCATAAATATTCCTATT
[C,A]
AATTTCATTGTGTTTCTGTAAGTAAAATTTCTCAACCTGTCCATGTCTTTTTCCATCTCA
ATTACATCAGCTGGTACAATTATTGTCCTTCTCAGTAACATCTGTGATTTGTTCTGCCTT

FIGURE 3UUUUUUUUUU

GCAATTTAGCTGTGTACTCTTATCATAAGAGCTCAGCACTCCCTGTGCAGCAATCATTTA
GTATACTCTCTAATTTTCTTCTTCATTGGTACAATTGTTTTTTCATTATTGGAATTCTGT
ATTTTGTAGTTGCCTATCTCTCACTCTTTATAGAATCTCTGATCAAGAAATTGTACCCAA

530571 TGATATATTCTTTACATGTCTATACAAATTCTAGTATATATAGAATATATGATATGGAAT
ATATGGTATATGTACTTTACATCTCTATACAAACATTATGTACTTTTCATATTCCCATTT
CATAAATATTCCTATTCAATTTCATTGTGTTTCTGTAAGTAAAATTTCTCAACCTGTCCA
TGTCTTTTTCCATCTCAATTACATCAGCTGGTACAATTATTGTCCTTCTCAGTAACATCT
GTGATTTGTTCTGCCTTGCAATTTAGCTGTGTACTCTTATCATAAGAGCTCAGCACTCCC
[T,C]
GTGCAGCAATCATTTAGTATACTCTCTAATTTTCTTCTTCATTGGTACAATTGTTTTTTC
ATTATTGGAATTCTGTATTTTGTAGTTGCCTATCTCTCACTCTTTATAGAATCTCTGATC
AAGAAATTGTACCCAATCCATGTGCATTTTTTAACTGCCACTCTGAAGTTTAATGTCTAC
AGTTATGGCCGTACTTTTTCCCTGGACTGTAAATATCTTAAAGTGAAAATGGTCAGTTTT
TTCCCAGGTTTCCCCACCCCTTGCATTTCATCAGTCTTTATTCAGAACTAAATCAAAATA

535153 ATAAAGCACGAACACATTGTACAGCTGTATAAAAGATTATCCTTATTTATATTCTTATTC
TATAAGCTTTTTCCTGTGTAAATTTTGTTTTTAATTTTTAAATTGTTTTGTTACAAACTA
AAACACAAACATACACATGAGCTTAGGTCTACACAAGATCAGGATCACAAATATTGCTGT
CTTCCACCTCCACATCTTTTGTCACACTGGAAGGTCTTTTGGGATGTGGTATGTGTAAGT
TCATTCTGACATTCCTAGAAATACCTGAGACTGGATAATTTTATTTTTTTTTTAAAAAAA
[T,A,G]
AGGTTTAATTGGGTTAAAATTCGACAGGTTGTACAGGAAGCACGATGCTGACACCTGCTC
AGCTTCTGGGGAAGACTCAGGAAATATATAGTAATGGTGGAAGGTGAAGGGGGAGCAGGC
ATGTCACATGGCAGGAGAGGAGCAAAATAGAGAGTGGAGGGGCAGGTGCTACATACTTGT
AAACGACCAGATCTCGCTATTATGAGAACAGCACCAGGGGGATAGTGCTAAACCATTCAT
GAGAAATCCACCCACATAACCCAATCATTTTCCATCAGGCCCGGCCTACAACACTGGGGA

547552 ATCTGACAGTCCACTAGCTCCTCTTAGACGTGGCTATCTAAACACAAGCCCTCCAATGAA
AATACTGATTATTATTATTGTTTTGAGGCAGAGTCTCATTCTGTCACCCAGGCTAGAATG
CAGTGGCACTATCTCAGCTCACTGCAACCTGTGCCTCCGGGTTCAAGCGAGTCTCCTGTC
TCAATCTCCGGAGTAGCTGGGATTACAGTCATTGCACCACCACACCCGGCTAATTTTTGT
ATTTTTAGTAGAGAAGGGGTTTCACCATGTAGGCCAGGCTGGTCTCAAACTCCTGACTTC
[C,A]
GGTGATCTGCCCACCTCGGCCTCCGAAAGTGCTGGGGTTACAGATGTGAGCTGCCGCGTC
TGGCCCAATACTGATTGTTTTTATTTCCTGACTAAATTCCAAAATGTCTTTTTTTTTGCTA
GTGCAGACATTCTCCCATACTGGGGTAAATGATATTCTCCCATGGTTGCCTTCTCAATTA
ACTATTGAAAATGTTTAGTGTGTACTTTCACATAGAGAGTTAAATACCGATGCAGGTGTC
TATCATGAGGACATATTTCCAATCAATCCATATTTTACTAATGTTACATATTTTCATTAA

547867 CTCGGCCTCCGAAAGTGCTGGGGTTACAGATGTGAGCTGCCGCGTCTGGCCCAATACTGA
TTGTTTTTATTTCCTGACTAAATTCCAAAATGTCTTTTTTTTTGCTAGTGCAGACATTCTC
CCATACTGGGGTAAATGATATTCTCCCATGGTTGCCTTCTCAATTAACTATTGAAAATGT
TTAGTGTGTACTTTCACATAGAGAGTTAAATACCGATGCAGGTGTCTATCATGAGGACAT
ATTTCCAATCAATCCATATTTTACTAATGTTACATATTTTCATTAAGTAACATTATTTAC
[T,C]
CATGGTGTTCAATATTGTGAACACTAGGGAATTAAAAAGAAGACAAAATCCTTGTCCTCA
AAAATTTCACAGTGTATGTTGGTAGGAATGTAAATCAGTGCAGCCATGGTAGACAACAGT
GTGGAAGTTCCTCAAAAAATGAAAAATAGCACTACCATATGATCCATCAATCCCACCACT
GGGTATATATCCAAAGGAAATGAATTCAGTATGTCAAAGAGATATCTGCACTGCTCATGT
TTATTACAGCACCATTCACAATAGTTTATTCACTATTCACAACAACCAAGATATTGAATC

552396 GGCTTTTGATGGGTAATTTGGGAGAGGGACCAAAGAAGCAGGGGTTTGCTCTAGATTGAA
TGCTATCAGAAAGTAAAGGCAATTCTATGATTAGACGTCTGGGTTTTTTTTTCTTTTTCA
TAAATGTTATTTTTAATTAACAATAATTTTATATATTAATGGGATGCAGTGTGATGTAAT
AGATGTGCATATTGTAGAATAACTAAATCAAGCTAATTAAAAAATTTGTTACTTCACATG
CTTATTTTTGTGGTGAAAACATTTAAAATCTACTCTCTCAGCAATTAAAAAATATACAAT
[G,C]
ATATTATTTATTACAGTTACCATTCTGGGCAATAAGATCATTAAAGCTTATTTCTACTGT
CTAACTGAAATTTTATATACTTTGATCAACACCTTCCCTTTCCCCACCGGTGCCCCCACC
CCACACTGAATCTGGTAACCACCATTCTCCTCCCTTCTTCTATTAGTTCAATATTTTTAA
ATTCCACATCGGAGATCATGTGCTATTTGTCTTACTGTTTCTGGCTTATTTCACTTTCCA
TAATGTCCTCCATTCCATCCCTGTTGCACAAGTAACAGAATTTCCTTTTTCTTAAGGAGA

556680 CACTGGGTCCCTCCCATGACACATGGGGATTATGGGAACTACAATTCAAGATGAGATTTG
GATGGGGACATAGCAAACCAGATGGCAAGCTCTGGCCCTGTGGTGGCGGAATTAGGTTGG
GTAAGCTTGTACTCACGTTCCCCCATGGGGCATGACAGTGCACCCAAATTCAGAGGGTTG
GGTGATGTGAGTTTAGGTCTCATGCCCCTGAATACAAGGAGTTGAAAGCTGAAATGGTCA

FIGURE 3VVVVVVVVVV

ATATGATCTGCAAAAGTGTAGGATAGTGACTACCAAACTGTCTTCTGGAGAGCCTTTTTC
[A,-]
AAAAAAAAAAAAAAAAAAAAGACAAGGTTTTGCTCTGTTCCCTGGTCTGGAGTGCAGTGAC
ATGATCATAGCTCACTGCAGCCTCAAACTCCTGGGCTCAAGTGATCCTCCCACCTCAGCC
TTCTGAGTAGCTGGGACTACCTTTGCCACTACACCCAGTTATTTTTTGTTTTTAAAATGG
TCTTACTATGTTGCTCAGTCTGGTCTCCACATCCTTTCCTCAAGTGATCCTCCCACCTCA
GCCTCTCAATTAGCTAGGATTACAGGCATGAGACACCATGCCCAGCTGGGAAGTGTTAAT

572534 ATTATTTCCCAATATGGTGTGGTGTGTGCTGTTTTCGTTATAATTATTCAATAATTTTTA
AATTTATTCATTCAGCAAATATTTATTTAGTGTCCATTTTTCTAGTCAACTTTTGTTTGT
TTGTTTGAGACGGAGTTTCACTCTGTCACCCAGGCTGGAGTGCAGTGGCACGATCTTGAC
TCACTGCAACCTCCACCTCCCAGGTTCAAGTGATTATCCTCCCTCAACCTCCCAAGTAGC
TGGGATCACAGGTGTACGCCACCAAGTCCAGCTAATTTTTGTATTTTTAGTAGAGACAGG
[G,T]
TTTCACCATGTTGGCCAGGCTGGTCTCGAACTCCCAACCTCAAGTGATCCACCTACCTCG
GCCTCCCAAAGTGCTGGGATTATAGGCATGAGCCACAGCACCTGGCCTCTAGTCACTGTT
AATACAGTAATGAAAAAAGACAGAACTAACTGCTAGAGGAGACAAAAAGAAATCTAAATA
TTTAAATGTAACTTTAGGTAAAGAGCAAAAACCTGAATGCAGGGAGGGAGCAAACCATGC
CTAGGTGTGATAGAAGAGTATTCTAGAGAGAGGAAACCACTAGTTACATACTTTTGTTTT

573886 GATATGTGCACACTGCAATCAGATTCAAAGATGTTAAAATGCAAATTAGATTGTGTTGAT
TCCTTACTTAAATTCCAAATGTTCAGCATTTTTCAGTTAATCATTAATCTAGTAATATTT
ATGAACTGCCTAGCTACTACATACTGGACACTTTCTCTCTCTTTCTTTCTTTCTTTCTTT
CTTTCTTTCTTTCTTTCTTTCTTTCTTTCTTTCTTGCTTTCTTTCTTTCTTTTTCTCTTT
CTTCCCTTCCTTCCTTCCTTCCTTCCTTCCTTCCTTCCTTCCTTTCTTTCTTTCTTTCTT
[T,C]
CTTTTTCTTTCTTTCTTTCTTTCTTCTTTCTTTTTTTTTTTTTGAGACACAGCCTCCCTCT
GTTGCCTAGGCTGGAGTGCAGTCGCAAGATCTGGGCTCACTGCAACCTTTGCCTCCCTGG
TTCAAGCAATTCTCCTGCGGCAGCCTCCTGAGTAGCTGGGACTACAGGCACATACCACCA
TGCCTGGCTAATTTTTGTATTTTTCGTAGAGATGGGGTTTCGCCGTGTTGGCCAGACTGG
TCTCAAACTCCTGACCTCAAGTGATCTACCTGTCTTGGCCACGGGAAGTGCTAGGATTAC

575479 AATCACTGGCTTATTTTCTCTCTTCCAGAGCACACTTCCCTTCTTATAAGAAAAGAATAA
ACTCTTTCTGTATGCAGGAATAATTTATTGGTTGTCCTTCTAGTGTTTAAATATCTGGGT
TTTCTCAAGGTCATTCATTCAAATCACCTCCCTAGAATTACCTCTAACCTATTCCCTAGT
TCTGTGGTTTTCTCCTGCCCCTAAACTATGCTGCTAATTGTCGGGTAGACTACACTATGT
AGTAACAGCTGTAAAAACATCTAGTAACAAGTTTCTCAGTGTGAAGGTATCATTGTAAAC
[A,T]
GTAAGAGCCAAAAAAAGAAGAGAATATAAATGCACTTTTATGCATACATAATGTTTTCTT
TTATACTGCTAAATAAAATTGAATAAAGCCATCTAAAGGATGAAATCTTATTGACTTTCA
AAGAATAAAAAATCTCTCCCAAATCATTCATGATATGATTTGTTCTAGATAAAGAGTGTG
ATAAATCCAAATTGGGAAGGGCTGTAGATAAACCCATATTACAGGCATGAATTCGCATCC
AGGAATTCAGGAGAGTAAGAACCAACCTGCCAGGCTGCAGGATAAGGCAATCAATCATCA

576859 TTTCAACTTTTATGTTAGATTCAGAAGGTCCCTGTACAGGTGTGCTGTATTAGTCAGGGT
TCTCTTAGAAGGACAGAACTAATAGGATATATATATATATAAAGGGGAGTTAATATTAAGTA
TTAACTCACATGATAGAAGGTCCCACAATAGGCCATCTGCAAGCTGAGGAGCAAGGAGAG
CCAATCTGAGTGGCAAACTGAAGAACTTGGAGTCCGATGTTCGAGGGCAGGAAGCATCCA
GCACAGGACAAAGATGTAGACTGGGAGGCTAGGCCTGTCTTGTCGCTTCATGTTTTTTTG
[-,T]
TTTTTTTTTTTTATACTTTACGTTTTAGGGTACATGTGCACAATGTGCACCTTTGTTACA
TACGTATACATGTGCCATGTTGGTGTGCTGCACCCATTAACTCATCATTTAGCATTAGGT
ATATCTCCTAATGCTATCCCTCCCCTCTCCCCGCACCCCACTACAGTACCCAGTGTGTGT
GATGTTTCCCTTCCTGTGTCCATGTGTTCTCATTGTTCAATTCCCACCTATGAGCGAGAG
CATGCGGTGTTTGGTTTTTTGTCCTTCTGATATTTTGCTGAGAATGATGGTTTCCAGTTT

576880 CAGAAGGTCCCTGTACAGGTGTGCTGTATTAGTCAGGGTTCTCTTAGAAGGACAGAACTA
ATAGGATATATATATATAAAGGGGAGTTAATATTAAGTATTAACTCACATGATAGAAGGT
CCCACAATAGGCCATCTGCAAGCTGAGGAGCAAGGAGAGCCAATCTGAGTGGCAAACTGA
AGAACTTGGAGTCCGATGTTCGAGGGCAGGAAGCATCCAGCACAGGACAAAGATGTAGAC
TGGGAGGCTAGGCCTGTCTTGTCGCTTCATGTTTTTTTGTTTTTTTTTTTTTATACTTTA
[G,A,C]
GTTTTAGGGTACATGTGCACAATGTGCACCTTTGTTACATACGTATACATGTGCCATGTT
GGTGTGCTGCACCCATTAACTCATCATTTAGCATTAGGTATATCTCCTAATGCTATCCCT
CCCCTCTCCCCGCACCCCACTACAGTACCCAGTGTGTGATGTTTCCCTTCCTGTGTCC
ATGTGTTCTCATTGTTCAATTCCCACCTATGAGCGAGAGCATGCGGTGTTTGGTTTTTTG
TCCTTCTGATATTTTGCTGAGAATGATGGTTTCCAGTTTCATCCATGTCCCTACAAAGGA

FIGURE 3WWWWWWWWWWW

588934 GCTTTCATAAAAATCTCTAGAAACATAATTTCTTTGGTTTTGATACTTATAACTATTTCT
GTGTTTGTATGCATCATCTATATATAACAATAATATAAACTATCAGCCTTGTTTATGATT
CATGAAATAACTAAGAGGATGGGAAAAAGTCAAATATTTTATGAAAGAAAGTACATTATT
AACAGCAACAACTTAGTGTAGCCATGGTTGTGTTGTTCATTAACTGCAATTTAGTTCTTT
TTCAATAGTTGCTTATAAATGGGGCTATGAAAATGAATGGATTTTTTTTTCTTTTTCTTA
[A,T]
CTTCTATTTGAACAAAACAAAAAGTATAAGAAGTGAAAATACATCATAAACCTGCTGTTA
AAATTATTATTAAAGGTAAAATCTGATTATCCTTCTGCCATCCAGTTGTATTCTCTAGAG
CTAACCCTTGTTAATAATTCAGAGATGGACTTCCTAAATTTTCCATAAAGGTTTGTAGAC
ACATTTATATCTACACTTATATATTGTTTTATGAACAAAAATGGAATCATGCTATGCAAG
TTAGTTGCAATTTTTTTTAATTTAACAGCTATTTCTTTTAGGTTTGACTATGAGTAACTG

591527 TTCTTCACATGGCACAGCAAGGAGAAGTGCAGAGTGAAGCAGTATGGAAAAGCCCATTAT
AAAACCATCAGATCTTTTAAGAACTCACTCACTATCTTGAGAACAGCATGAGGGTAACTG
CCTCCATGATTCAATTACCTCCACCAGGTCCCTCCCAGGACACATGGGGATTATGGGAAC
TACAATTCAAGATGAGATTTGGGTGGGGACAGAGCCAAACAATATCAGTGTGTCTTACTA
TACAGGTTCAAAGCAAATCCTGAGTGCATTTTAAAACATTACTAGGTAGTGATCATTGCA
[C,T]
AACTTTGTAAATCTACTAAAAATCACAGAACTGAAAATCCTTTAAAACAGTGGAAGTTTA
TGGTGTGTGAATTTATATCTCAATTAAAATTTTTAAATAAAACGATTATTTCTCTTAAAG
TATAAAAATTAAATAATGGATATTATGGGGTGATAACCTCTGCTAAAACTGTGTTATTTT
CCAGATTAGTATAGTACATACAAATATTTCTCTTTTATTTTTGTGTCTGCCCTCTATTAT
ATGAGTGTATTCTCTTTTACTTAACCTTTCAATCTATTGAAACTATGCTATAATTTATAT

591634 ATGAGGGTAACTGCCTCCATGATTCAATTACCTCCACCAGGTCCCTCCCAGGACACATGG
GGATTATGGGAACTACAATTCAAGATGAGATTTGGGTGGGGACAGAGCCAAACAATATCA
GTGTGTCTTACTATACAGGTTCAAAGCAAATCCTGAGTGCATTTTAAAACATTACTAGGT
AGTGATCATTGCACAACTTTGTAAATCTACTAAAAATCACAGAACTGAAAATCCTTTAAA
ACAGTGGAAGTTTATGGTGTGTGAATTTATATCTCAATTAAAATTTTTAAATAAAACGAT
[T,G]
ATTTCTCTTAAAGTATAAAAATTAAATAATGGATATTATGGGGTGATAACCTCTGCTAAA
ACTGTGTTATTTTCCAGATTAGTATAGTACATACAAATATTTCTCTTTTATTTTTGTGTC
TGCCCTCTATTATATGAGTGTATTCTCTTTTACTTAACCTTTCAATCTATTGAAACTATG
CTATAATTTATATCCAGGTCATACTTTTATTATCATAGGATAGATTCATAGAAGTGTAAT
TCATGAGTCAAAGAATTTGACATCAGTTTGTGATTTCACATCACAAAGGTCATGTGATTT

591638 GGGTAACTGCCTCCATGATTCAATTACCTCCACCAGGTCCCTCCCAGGACACATGGGGAT
TATGGGAACTACAATTCAAGATGAGATTTGGGTGGGGACAGAGCCAAACAATATCAGTGT
GTCTTACTATACAGGTTCAAAGCAAATCCTGAGTGCATTTTAAAACATTACTAGGTAGTG
ATCATTGCACAACTTTGTAAATCTACTAAAAATCACAGAACTGAAAATCCTTTAAAACAG
TGGAAGTTTATGGTGTGTGAATTTATATCTCAATTAAAATTTTTAAATAAAACGATTATT
[G,T]
CTCTTAAAGTATAAAAATTAAATAATGGATATTATGGGGTGATAACCTCTGCTAAAACTG
TGTTATTTTCCAGATTAGTATAGTACATACAAATATTTCTCTTTTATTTTTGTGTCTGCC
CTCTATTATATGAGTGTATTCTCTTTTACTTAACCTTTCAATCTATTGAAACTATGCTAT
AATTTATATCCAGGTCATACTTTTATTATCATAGGATAGATTCATAGAAGTGTAATTCAT
GAGTCAAAGAATTTGACATCAGTTTGTGATTTCACATCACAAAGGTCATGTGATTTTTTT

595008 GAAAACCCCTTTAAAAAATTCTATTTGATGTTCTCAAAGAGAGGGGGAAAGATACTGCAT
CCATAAAATAAGAACAGGTTGCCATTAAAAAGAAAAAAAAGAAAAAAATCCCAGCCAAAC
TATCTAGAGTGAGAGTCAAAAAATAAAAACCAAAGAAGAACTGTTTAAACATGTGCAGGA
ATAAGAAACTCTGTTTTCCTGAAATCATGATTGAAATAAAAAAAAAAGAATCCATGGAAT
AGAAAGTTGTGGATTTTCAGAAAAGTGATATATAAGCACAAAGAAAAGAAATTCCAGGAG
[A,G]
ATAATCATGCAAAGTGCCCTGAGAACGATTGATTTAAATCAGAAATATAGTCTTAGGCCT
TCACAAGAGTGTATTTAAATATAAGAACAGTATGGGTTTTGTTCAACAGATAGTGTGATT
GTGAAACTAGAGCATCTAAAGGTAGCTACTAGGTACATGTGCTTACTGAGATTTAAATTG
AAATTAATGAAACTTAAATACAATTTATAATTTGGTTCCTCAGGCACACTAGCCACATTT
CCAGTGCTCAATAGCCACATATGGCTGGTGGCTACTGTATTGGACAACACAAACATAGAA

595627 AAATTGGAGTGAACAGCTTTGATCTTGGTGATATGGTGAGCTTATTGCTTTCATTCATTC
TTCAAAGAATATTCATTGAGTAGATTCATTTTGAAGAAAAGGACAAACTGAGAATATAGC
ATCTATAATGAGTGAGTAAAGGCCTTGTCCTTCTATGGACGTAGCATCTAAGAGAAAGAC
AATAAACAAATACAGGGATACTCATTTTTATTGCATGCTTCTTTACTGCTCTTCACAGGT
ATTGCGTTTTTTACAAACTGAAGGTTTTTGGCAACATTGCATTGAGCAAATCTATCAGTG
[T,C]
CATTTTTTCAACAGTATGCACTTACTTCATATCTCTGTGTCACATTTTGGTAATTCTGGC
AATATTTAATTTTTTTATTATTATTACATTTTGATATTGATCTGTGATTGATGATCTCTGA

FIGURE 3XXXXXXXXX

TGTTACTATTATAACAGTTTTGGGATGCCATGAACAATGCCCATGTAAGATGGTAAACTT
AATTGATCAATGTTGTGTGTTTTCTGACTGTTCCACCAATCAGCCATTCCTCCATTTCTC
TCTCCTCAGGTCTCACTATTCCCTAAGGCACAATAAGATTGAAGTTAGGCCAATTAATAA

604393 AATGAATAATCAAATGTTAAAAATAAATAGTGAATGAGCCCAACAGTCTCCCAATGAAGT
ATTTTACTTAAAAGTTAAGAAATGCTTGATTTTGTATTCATTGGCAGTGATTAAAAGAAC
AGACTCTAGGGTCAAGCTGCTTGGATTCCTAGCTTAAATTACTTATTTAGGTGACTTTGG
GAAATTATTACTTCTCTGCAAAACTCAGGATATAATAGTTCCTTCTTCATTTGGGTTGTT
AGGAAAACTAACTGAACATATATTTATATTATGAAAATTGTATTGTGAAGAGTAAATGAG
[-,C,A]
ATATTGTAATTACTATATACATTTTCAAAAAAATACTTTCAATGACAAAAGATTAGAGGC
AAAACTATTGTTTTAATTGAAAGGGATTCTTATTCTTTGTGTCTGCATATATTGAAAACT
CTGAGCTTAAATTATGAACAGTATTTGTGTAGTTTCTGGTACTTCAGTTTCTAGGATACA
CATAAAAATGCATCTGTTTGTTGAAAATAACAAAGTGCTTTTTTTCCTGGTTCATGTTGG
TCAAATGCCTGCTGCAGTCAGTTTTAACACCCATGGCTTTTCTCTCTGTGTATAGGATGA

606325 CAATTAGCAGACTCTTGCAGTAGTCAAAATTAAGTGTAATAAGGGCCAGAGGTGGCATGG
TAGAAAAAAGACTATAGGGGTTGACACAAAGAAGATTCAGGAGAAAAACCCTCCTTAAAA
AAAAAAAAAGTTTTAAAGTTAAAACCCTTTCATTTGAAGCAATTGCATATGTTAGGCAAT
TTCTCCAAAATTTAAGTGCTAATTGATAGATTCTGAAGCTGTCTTGCAAGGAAGTTCTTG
TACCCTTAGAAAAGTCATTCTCTCAGTGACCTGGTTGCTGCATTATCATCTCAAATGCCA
[-,T]
TTTTTTCTTACTGTTTCATTACATTGTCACCTTCAAAGGACAAAATTACATGTAAGTCAT
AAATCTTATTTCCCTAAGACCAAAAGAAAATCTTCCTTGAAACTCATAATGAAACTCTTT
CCTGTTAAATGCCACACAGCAGACACACGTTAGACCTGAATTCTTCCGTATTAGACTCAA
CATGAATTTGCTATTAAATAGCTTTTAACTGAGATCAAACAATAAGAACCTACAAAAGAG
CAAATTCTCAGTTCACAAAAGACTAATTGCCAAGCTTGCAGCATTTATAAACATCAAGGT

607062 TTTACTTTTTTCCCTCAGTCAGCATTCTATGTATATAATGCAAGCTATCTTCATCTTGGC
AATTTATCTATCTAAAGTAGAAGTTTTCTTGGACCAAAAATCTATGTTGTTCTGATTAAT
GCCAGTGTCAACTAAAACACTGATCTCTTTTCCTTTTTTTTTTTTTTTTTTTTTTGAGACG
GAGTCTCGCTCTGTCGCCCAGGCTGGAGTGCAATGGCACTATCTCGGCTCACTGCAAGCT
CTGCCTCCCAGGTTCATGCCATTCTCCCGCCTCAGCCTCCCAAGTAGCTAGGACTACAGG
[C,T]
GCCCGCCACCACACCCAGCTAATTTTTTGTATTTTTAGTAGATACAGGGTTTCATGGTGT
TAGCCAGGATCGTCTCGATCTCCTGACCTCATGATCCACCTGCCTCAGCCTCCCAAAGTG
CTAGGATTACAGGCGTGAGACACCGCGCCTGGCAAAACACTGATCTCTTAGTTACTCCTT
TTTCCTGCTTTTTTGTCTTTGTTTTATGCTGATATTTTAACATGTTTATTGGATTATAAG
TCACTCTTGGTAATATGAGCCCTTGGTTTGGTAATAGAGTATAATCATAGTAAATGATAC

607105 GCTATCTTCATCTTGGCAATTTATCTATCTAAAGTAGAAGTTTTCTTGGACCAAAAATCT
ATGTTGTTCTGATTAATGCCAGTGTCAACTAAAACACTGATCTCTTTTCCTTTTTTTTTT
TTTTTTTTTTTGAGACGGAGTCTCGCTCTGTCGCCCAGGCTGGAGTGCAATGGCACTATC
TCGGCTCACTGCAAGCTCTGCCTCCCAGGTTCATGCCATTCTCCCGCCTCAGCCTCCCAA
GTAGCTAGGACTACAGGCGCCCGCCACCACACCCAGCTAATTTTTTGTATTTTTAGTAGA
[T,G]
ACAGGGTTTCATGGTGTTAGCCAGGATCGTCTCGATCTCCTGACCTCATGATCCACCTGC
CTCAGCCTCCCAAAGTGCTAGGATTACAGGCGTGAGACACCGCGCCTGGCAAAACACTGA
TCTCTTAGTTACTCCTTTTTCCTGCTTTTTTGTCTTTGTTTTATGCTGATATTTTAACAT
GTTTATTGGATTATAAGTCACTCTTGGTAATATGAGCCCTTGGTTTGGTAATAGAGTATA
ATCATAGTAAATGATACTCCACATGGTTCTTGGCCTTCTGATTCTTAGATTTTAAGTCTC

611772 GACATTAAAATTAGATTAGAGATGACCCGTGGAATGTTTGCACTTATTAATCACAATTCA
ACCTTGAAAAAAGAAAAAGATTTCTATTACATAATGGTAGAATGTATAAGACAAAAAAAA
ATGAACTCAGTCACTCATCAGTTTTTAAGTGTGAAAGGTACAATGAACAAGATAACATGA
CATTTGCCTTTGTGGAAATTATAATAATGGTGAGGTTGTGATAGCAAAAGTGTGGGCTAA
TGTGGAAGCACATCTCAAAGGCACCCACATTGGTAGAAGGATGACAAGATTGAGGGGACT
[C,G]
TTTTGTTTTTCTTTTCCATTTATTTATTTAGAGACAAGATCTCACTGTGTCTCCCAGGCT
GGAGTGCAGTGGTACAATCATGGCCTACTGCAGACTCTGGGCTCAAGCAATCCTCCTGCC
TCAGCCTCCCAAAATGCTGGGACTACAGCTGAAAGCCACTGCATCCAGCCTGCTTTTTTC
TTTTAAAACTCTTAAAATTTGATTGAAAGTGAAATTGTAAACGTAGAGTTGGAAGTTCTG
GAACTGGAAAATAAAATTGCAAAGGAAGAAAAGAAAATTTGCATAAGACTTATCCAAAGT

612925 TATTTGGGTCTTTGGAAGTTATGTTTCAATGTGACTTCATTTCTCATTCATTTTCTGATG
CAGTGACAGACTGAGAACAATCCAGGCAGATGAGTGGCATCTGGGTTGGTGGATAGACTC
AGAAATAATTGCCCAGATAGAGTAAGAAGAATAGGCTAGAACAGCCAAAATTACATCCAT
GAAGTCTGTTTCAAAATCTGAGTATGAGATAGAGTCATCAGAGGATATTGACACAGTTAA

FIGURE 3YYYYYYYYY

TTTAGGGACCAGGAATGCTAAAAAAGGAAAAGCCAGACTATCAGCATAGAGTCAGATTCT
[-,G]
TTGTAAGTGACAGAAAACCCCAAATAAAAAGTAGAAAAATTATTCCTTTCACAAATAAGC
AACATCCAGAGGTAAGCAATCAACAGCTAGTAGGATAGCTTCGTGAACCTCCGAGACCCA
AGATCCTTCGACATACTGAACAGCTGTCTTCAGCACACTGTCCAGGATGGTTGTGTAAGT
TGCATTTTTCAAGAAGGAGGAAGGGGCACATATAGTCCCATTTCCTCCTTTCAGGGATAC
TTCCTGGAAATTGCAAACACTACTTCCATTTCCACTCACTGATCACATAGCTTCATCTGG

613447 TTCCTCCTTTCAGGGATACTTCCTGGAAATTGCAAACACTACTTCCATTTCCACTCACTG
ATCACATAGCTTCATCTGGATGAGTAAGAAAGCTGGAAAAATATGGTCTTTATTCTGGCC
AGCCATATGGCCCTTAACGACAGGGGTTTTGAAACTGGGATGAAAGAAACAGGTATGGAA
AGGCCACTGTCAGTCTCTGCCACCATGAGCTCAGATCATGACTAGAGGTATAGGACTTTC
CTCAATCATCAAGTATGAACTGAGGTTGTTCCTTTTGGAGGATACCTTGCCATGTACTTT
[A,G,T,C]
GGGGCTGATTTGGCCTTTTAAAAAGATTTTTTCAGACCGAAGATTTTCAAATAGTAGAGA
TTATTCTTACTTTTTTAACTAGATATGCATCATAAATTTAAAAAATTTCAGGGAACTAAA
ACTTCTGTTTCATTCAACTGAATTTTTATAACAGTCTTATACACTTATCTATTGTGTATG
AATGTGTTAAAAATTTGGTCAGTCAATACTTTTAAATACAATCACACATACACACATGAA
TGCTTGCCCTTATGCAACCATTTTTCTTTGGTCTATCAATATATGCCATTAACCTAAAAA

613750 GGCTGATTTGGCCTTTTAAAAAGATTTTTTCAGACCGAAGATTTTCAAATAGTAGAGATT
ATTCTTACTTTTTTAACTAGATATGCATCATAAATTTAAAAAATTTCAGGGAACTAAAAC
TTCTGTTTCATTCAACTGAATTTTTATAACAGTCTTATACACTTATCTATTGTGTATGAA
TGTGTTAAAAATTTGGTCAGTCAATACTTTTAAATACAATCACACATACACACATGAATG
CTTGCCCTTATGCAACCATTTTTCTTTGGTCTATCAATATATGCCATTAACCTAAAAATT
[A,T]
ATCTCCTCTTCATTTTTATTTCATGTTTATTTCTCGACAAGCCTGTTCCACTATCCAGTA
TTTATGTTTGCCAGCAATTCTTTTCTATAAATACAGTTTGCTAGATTATAGCTAAATCTA
TACTTAAATACAAACTCTCTGGCACTTTCTCCAAACTCAAGGTTTGTGATTATAATTAAG
CAATAATATTGTCACTTGCTTTTTTCTTTCTTGAAAGTACCTAATCTCCTTAGGTATCTG
CCCCTTAGTGCTGTAAAGATGTGATTTGAAAAGTAAGTTTAAACCGTTCTTTCAATTAGG

615704 AGATATTATTCCAGGCAGTCTCAACATGCCCAGTTTTAATGTGACTAAACAGTCATAAAG
TCAGGCTTCTTTGAGTCTGTTTCCGTTTTCTCCCTATTATCAGGAATGAGTGTTGTCTCA
TATCAGACTTGAGAATTAGGTGAATATACGCCTCAGTGGCATCCAGCTTACAAAAAGGAA
TAGCCTCACTAAAAGTTAGAAGTTACTTGAAACTGTATAATGCCTGCCTCTTTCAAACCC
ATTTCACACTTATGATCTTATTTGAAAATAGAGCCCAACACACTGTTATTACTTTGCTTC
[G,A]
AGGCCATAGTTGAGGTGAAATTGGCTGGCTCCTATACAGGAGAGTTAGGCCTGCAGAGAA
TGAATGCTAAGTCAGTCTCTCCCCTCATGGAATAGCATCCCTAGCTATGTGCCTCCCTTG
TCTTTCATGCTCACATAAGCAGTCCAAATTGCTCCACCCTCAAGATCGTCTCTCTGTCTG
TCTCTTAAATACATAAATGAGAAGGCACATATGCAACCCTGGGATAAATGTTGGGAAGGA
TATATGTGGCCCATGTCTGGCTGTTTGTATTATTCAGTGTTCACCAATCTGTCTGGGAGA

619831 CATGAAGGAGAAGGAGGAAAATATTTATCCCCATGTATTGAACATTTATTGCCAACCGCT
AATAGGCAGTCCTCATGTGATTCATGATAAACCAATATGTTTATTATTAGCTCCACTTTT
CAAATGAGAAAACTGAATGAAAGAGAAGATAAATAACTTATCCAAGATTAATCAGTTAGT
GAATGGTAGAGTCAGAATTCAAAGTTCTGCCTGACCTCAAACCTAGACATTTTTATTACT
AAACATGATGGACGTATTAGCAGATTGTAGATTTATTCAGGACACTTTTTCAGTAATTAA
[G,A]
AGTCCAAGTTCCACTGAATATAAGCAGAGGCAAAACCACTGGTCCCAGCCTCCACTTAGG
GAAAATACATGCTTCATTCAGTGTAGCGAATGGAATAAAAATTATGTAAATAGACTTTTA
GAGCTTAAAGGAAACTTAGGAAAGTTACAGTCCACGTTCAGCATTTTGCAGGTGAGAAAA
TTCAGGCATTTAAAATATTTGCTTTTAAAAAGTCGAAGAACTTCTATTTTAAATACAAAT
TAAAACCTACCTTTCAATATGTCTTAGTCTTAATCAACTCCAAAATATTTTAATTCTCCT

621458 ATTGGTCTTCCTCACTGGTGACATAAACTTATTGAATCTCTAGCCTCATCCACCATCACA
GAAAACAAAGAAGTATTTGCTCAAACAAAAGAGGTTTATGGTCTTACTTCTGTTAGTGAA
GGAAATAATGTATAATGTTATAAATTACTATAACTAAAAAAAAAAGAGAGAGGCATGTAG
GAAACAAAATATGAGTTACACAAGGAATGGAGGGAAATACACAGTCTGACAAAGTAAGGA
TAAATGAAATTAGATAGGAGACAGAAGATAGAAAGATGGTAGGTAGGTCAGTACTTAGAT
[A,G]
GATGGATGGATAGATGATGGATGGATGGATGGATGGATAGACAGACAGACAGACAGACAG
ACAGATAAGGTTTGAAGTTTCAGGAATGAGCCTTCTTCAGGGAAAGTAGCCCTTGGCATT
GCATTAGGTTCAATAGACTAGTTTATCTTTGCGCTTTGAAGTTATTCTTACTGTAGCTCA
GAGGTACCAGAGTTCATCCAAAACCAGTAAGGGAATGGCTACTATGTGCCAGTTACAGAA
CTCAATACTGGATACTCAAGTATAAAGAAAGGGCAGGGTGTGGTGGCACATGCCTGCAAT

FIGURE 3ZZZZZZZZZZ

621497 CTAGCCTCATCCACCATCACAGAAAACAAAGAAGTATTTGCTCAAACAAAAGAGGTTTAT
GGTCTTACTTCTGTTAGTGAAGGAAATAATGTATAATGTTATAAATTACTATAACTAAAA
AAAAAAGAGAGAGGCATGTAGGAAACAAAATATGAGTTACACAAGGAATGGAGGGAAATA
CACAGTCTGACAAAGTAAGGATAAATGAAATTAGATAGGAGACAGAAGATAGAAAGATGG
TAGGTAGGTCAGTACTTAGATAGATGGATGGATAGATGATGGATGGATGGATGGATGGAT
[-,C,A]
GACAGACAGACAGACAGACAGACAGATAAGGTTTGAAGTTTCAGGAATGAGCCTTCTTCA
GGGAAAGTAGCCCTTGGCATTGCATTAGGTTCAATAGACTAGTTTATCTTTGCGCTTTGA
AGTTATTCTTACTGTAGCTCAGAGGTACCAGAGTTCATCCAAAACCAGTAAGGGAATGGC
TACTATGTGCCAGTTACAGAACTCAATACTGGATACTCAAGTATAAAGAAAGGGCAGGGT
GTGGTGGCACATGCCTGCAATCCCAGCACTTTGGAAAGCCGAGGTGGGCGGATCACCTGA

623282 CTGCCCAATTTTGGAAAACACTAGTATGAAGTAAACTTATTACTGAACAAGGTGTAACAG
AAGAGGACCAAACACAGTAACAAGTAATCTTCCTGCACCACGTCAAACACATATGTGTGC
ATGTATTTCAAATTTCCAATTCTAAATTTTCTGTCTTTTATTAAGTCAGTGTATCTATTG
TCTACTTATAGATCTTAATGTGTATTTGCAAAAATGCAACCTAATGAAAACAATTTGAAG
AAGTCATATCTCATTTATATTACAGAGATATTATCCTTACTATTAAACTTTTTGCCATCA
[-,C,A]
AAGTAAATTATTAACATGTCATCTTCAAAGAAGGGAATCTTTTCTATGAGGAGTTTGTAT
ATGTATGTGGGGGAATCTGCATTAGGAAATTTTATCAATTTATTTCAATTTTATGCTTAA
AGGCTTATTTTTAAAGAAACACTAAGACTGCTAAATAATAGCAATGGTTTATATTTATAA
TCATTTGCTACATTTAATTCTCATGAACAGCCCACTAGAGTCAGTTATAATTTTCAATTT
ACAGATGATGAAATTGAAGCACAGTTTAAGCTCATTGTTAGTCTGTTATCTTTTACACAA

623691 TTTTATGCTTAAAGGCTTATTTTTAAAGAAACACTAAGACTGCTAAATAATAGCAATGGT
TTATATTTATAATCATTTGCTACATTTAATTCTCATGAACAGCCCACTAGAGTCAGTTAT
AATTTTCAATTTACAGATGATGAAATTGAAGCACAGTTTAAGCTCATTGTTAGTCTGTTA
TCTTTTACACAAATGTTTTTTGACAATTTGCCTTCAGAGCTGATTTGTTAAGCACATGTG
AAAATTTCTTTCCTTTTTTATAATTTCAACTTTTATTTTAGATTAAGGAATACATGTGCG
[A,G,C,T]
GTTTGTTACATATGCAAATGTTTAATGATCCTTAATTTACAACATAGAGATATTTAAGGG
AGATTGCTACAATATCAAATTTAAAAGATATTTTGTTTCCCAGAGTTTAAGTCAAGCTT
GTCCAACCTGTGGCCTGGGAGCCTCATGTGGCCCAGGATGGCTTTGAATGTGACCCAACA
CAAGTTCCTAAAGTTTCTTAAAATATTATGAGGTTGTATTGCGATTTTTTTCTTTTCTTCT
CTTTTTTTTTTTTTAGCTCATGATCTCTCGTTAGTGTTAGTGTATTTTATGTGTGGCCCAA

624893 TTCGTGGAAGCAGATATTGCTCCTGCTACACATTTTAGATTTCATTTACTTTTTAGCTAC
AATATCATTGAATAATAAATTCCACAATTAATTGAAAGAAAACAGACAGACAGAGTTAGC
AACTTAAGCAATTGGGAAAGCCAGACTAAAACTAATTTATATCAAACCCCAAAACTTAAC
ACCTAGTGGATGAAGAAACAAGGAAATTATAACAAAGAATTGCTGTTTCTCCTGAATAAA
TTGTGAAAGCTTACTTTAGTGTTTCATGCAATCTCTGTTGATATAACTGACCTTAAGGAG
[A,C]
AAAATGATAAGGCATTACTATCACGTAATATCTCACCTGAATATATATTCATGTACACCA
GTCCTTCTATTTTGTTTGTCTGTTTTTTCAGCTGTGAAAAATGACAGTTCCTTAAGGAAG
AGATGCCACAATAGATGAAAGACCTTTTTACCCATGGTAAAGAAACATAGCAGAGACATT
ATGAATGATGCAGGAAGCTTAGGAAAATGAAAGCTGCTATTAACTATGACAGGCTGTCAC
AACAACAAAAACAGTAATCAATGCAATCATAGCAATAAGATAATATTTGTATTAGTTTCT

627654 TTAATGTCAATTTTTATCTCTTAAAAGGATCCTTCCCGGCCATTGGGGTGGAGGCGTTTT
GCCCCAGCTTCCTGAGGGCAGGGTTTTTAAATAGCATCCAGGCCCCGCATCCAGTGCCAG
GGGGAGGATCTTTGCCCCCCAGGATTCCTGCTGGTAGGTATTTCAGGTGAAGTTTTCTGC
CACCATATACAGCAGTAGGATTGTGCTCATAGTTGATAGGCCCCAAATACAAAATGAATA
TTGCTTAAATATATTGTGGAAAAGAAATGTAAGTGACTGCTTAAATTCAGAAACCATATT
[T,C]
ATAATACTGAATGCTGTCAAAATGGCACAAAGGAAGTGAAAGGACTCTGCGCACCTAATT
CGCATAGTGCTGCCTCCTCTCCTGAGAAAATTTTTACTTAAGTAAGAATTAGAGCTTCAG
ATCCAAAATATGTAACTCAAGAATAAACAAAGATGGACTTCAGACACTTTGCCACTTGGA
ATTGGCCAGAAAAGTGAATTAAAAACTAAGTGTTCTTGGCAGAAAGAGTAATTTCATAGA
GTTGATAGAGAATTAAAGTATCCTTTCATTACAGAAAAAAAAATGATTTGAAGAAACCAG

639109 CGTCAATTCTAGATTAACCATAAAACATGTTACAGGCAAAAATCTGTAAACAGAGTGCAG
AAGATACAACATAGATTGTTAATGGGAATAAGAACCTACTTTTAGCAGATGTTATTGTTA
AGAAATTATATGTTATAGTATGTTATTTAAAATAGGAAAATACTCATATAAATTGTTTTA
CTCTACCCTAAGAGAAACCATCTTGTTCATTGAAGCAATTTCAAACCTGTCAATTTCAGG
CATATATGATTTAAATGGACCTTTGAGACCATCAGAGAGCTCCTAAATTTACTGACACTA
[G,A]
TCATTTTACTAATGAACCTTATTAGCTCTGCAAACCACTTCTTAGCTTAGGATTCAACAT
CTAGTCAGTAAGGTAGCATATAATACTCAACATATAGCCATTCATTTAATTAGCTGTTAT

FIGURE 3AAAAAAAAAA

TGGGTGACTCAATATTCAGTATTTGGTTCTATTCTCTGTTTTAAACACATTATCCTTTTC
ATCTCACCACCCTAAGGAGGAGGCTATAATAATATACCTATATATAATAAAATCAATAAT
AAGATACAAATGAGGAAATTAAATATGCCAATGAGAAATATATAATATTCAAATGAGGAA

643935 CTATGATTAGCTCTATGGCAAGTGACCTTGAGAAACCCAGTGAATGAGGATACAAAGCAT
TATGGGAAAATAAGAAAGAAAAACAACTTAATATAAAAACAGGCACAACATTTCATAGTG
TACACAACAGATGTGATGGAAATGCAACTATGAGAAATATCACTGTGAGAGACTTTTAGG
GAAGAGGTGTGTTGTATAAATTCTAAGGGAGTGGGGAGAGACGGTAAGATTAGAGAGAGA
AGCAAATTGGGAGATTATCCTGGCAGGTGACTACAAAAGTAAAGGAAGAAGGAGACAGGA
[T,G]
TAAATAAATACAAGTACTAATAACAACTGGTAAAGCCGTGGATACAAAGGCTAGTTAGGA
AAGATGAGGTGCATCACTGGAAAGAATTGACTAACAGGGTGAGACTTGGAGCTTTTATCT
ATAAATGCTGTCTGAAAGGCACCTATAGCATAAAGGTTAAGATCTCAAACTCTGAGACAG
ACTACTTGATACTGCCACTTACCAGCTATTTGACTTTAGACAAGCAGTTTAATTTTCTAT
CCCTCAATTTCCACATCTGCATAAGAAAAATAATTATGGCATGTAGCAATACAAGTGGAA

644067 GTGATGGAAATGCAACTATGAGAAATATCACTGTGAGAGACTTTTAGGGAAGAGGTGTGT
TGTATAAATTCTAAGGGAGTGGGGAGAGACGGTAAGATTAGAGAGAGAAGCAAATTGGGA
GATTATCCTGGCAGGTGACTACAAAAGTAAAGGAAGAAGGAGACAGGATTAAATAAATAC
AAGTACTAATAACAACTGGTAAAGCCGTGGATACAAAGGCTAGTTAGGAAAGATGAGGTG
CATCACTGGAAAGAATTGACTAACAGGGTGAGACTTGGAGCTTTTATCTATAAATGCTGT
[A,C]
TGAAAGGCACCTATAGCATAAAGGTTAAGATCTCAAACTCTGAGACAGACTACTTGATAC
TGCCACTTACCAGCTATTTGACTTTAGACAAGCAGTTTAATTTTCTATCCCTCAATTTCC
ACATCTGCATAAGAAAAATAATTATGGCATGTAGCAATACAAGTGGAATGCTTGCAAGCT
CTTTTTATTCTAGTAAGACTGGTATTCTTAAGGGAAGGATAAATGTTTGTTAAAGAAAAT
AAAAACTAAAAGTATTCCTCTGACAGCAACAGTCAAGACAGATTAAAAAGCTGTGACTCT

646300 TGCAGGCAGACCAGTAATGATTGTGGTGGAATATATGGAGAATGGATCCCTAGACTCCTT
TTTGCGGGTGAGGTGTTCTTTTCTGATGGCATTTAAATAAGCTATTCTCAGTTCTATATT
TAAATCATTTATCATAAATTAATTTTTGCATAATGTTATTCATGGATTTTCTGTGAAGAA
TAGCAGTGTTTTCTCTAGGGTGCATTTCCCTGATACTGTGATACATTAGAGTGTTACTAA
GGGGGGAGGATGTACACTCAATAACGTAATTGATTTCTCCTCTAAATTCACTTGCTATAT
[C,G]
TGTGTGTATATATATGTGTGTGTGTGTATACCAAATAATGTTATCATGAAGAAAGATTAA
ATGAAACTCAATTGCCTCACAGTCATTAATTTTGCTTTATCACATTTAACTATGTAGTAT
GATATTGTATGCATTATCTATAATGCTGAACTCCTTAACTGATCTGTATTTACCAACAAT
GACTCAAGTTCATTTCAGAAAATGTTCTATCAACTTTGTCCTTCTTCAGTTCATTTGGCT
GACTATTCAGAAAACAAAGGGAGGAGGAATAAAACTCCTTTAGCAGAGATTTCTTTTACA

647248 TTGCCACTTGGGATGTTACATTATTTTTCTTCTTTATTTTCATGTGAAAATAAAGCATTC
ACTTCACTTCGTTTTTTGCCCCATGTTATGTGAATAAGTTCTGTTTGCATCTCATCTTTC
TCTCTTGATCTCATTTTCATTTATTTTTCTTGGTTCTGGCCCTCTTCTTCCAACTGCTC
TGAATGCTAGCAGTGATGATATATTTATACTCTGACTGGGCTTGATGTCCAGATTCAATC
CTAGAAGCTGAATTCAGCAAAATCATCAAGTTATTATAGAGCAATGCTGCTCGTGCAGTG
[T,C]
ATACTCTCAACCAAGTGTGCTCTGTAAGGTAAAATGAAATTCAGAGGTGTTTGGGGACAT
GAACTGTTTGTTCTTTTCTGTAGCCATTCTAAAAATGTGTTATTTTATAGCTTGTGTTCA
TTTAACCTGTTCTAAATTATTTTAGAATAATTTACAGGACCACCTATGGTACTTGAAATG
CTGTGTACTTAGTACTTGAAATGCTGTATACTTAATGTCCTTCCATTATGTTTCTTCAAA
AACTCATTCTTATCAGATACATATCAAAATGACTCATCATCTAATGATGCTTGGGTTAGG

647445 GATATATTTATACTCTGACTGGGCTTGATGTCCAGATTCAATCCTAGAAGCTGAATTCAG
CAAAATCATCAAGTTATTATAGAGCAATGCTGCTCGTGCAGTGTATACTCTCAACCAAGT
GTGCTCTGTAAGGTAAAATGAAATTCAGAGGTGTTTGGGGACATGAACTGTTTGTTCTTT
TCTGTAGCCATTCTAAAAATGTGTTATTTTATAGCTTGTGTTCATTTAACCTGTTCTAAA
TTATTTTAGAATAATTTACAGGACCACCTATGGTACTTGAAATGCTGTGTACTTAGTACT
[T,A]
GAAATGCTGTATACTTAATGTCCTTCCATTATGTTTCTTCAAAAACTCATTCTTATCAGA
TACATATCAAAATGACTCATCATCTAATGATGCTTGGGTTAGGTTGGTTTTCTTTTTATT
TTCTTCTTTTTATTTTTGTATCAGCTGTATCCTAAAGCAGAATATAATGGCAAACAGTGT
AGCAGATATTCAATCTAAATTGCTGCTAAAAATGGATCAAATGACTACCACAAGCAAATA
AGGTGGGAAATATTAGCTTCTCCCCTAATTTATATATTTTATTCTGTGGAATAATGAATC

647757 TACTTAATGTCCTTCCATTATGTTTCTTCAAAAACTCATTCTTATCAGATACATATCAAA
ATGACTCATCATCTAATGATGCTTGGGTTAGGTTGGTTTTCTTTTTATTTTCTTCTTTTT
ATTTTTGTATCAGCTGTATCCTAAAGCAGAATATAATGGCAAACAGTGTAGCAGATATTC
AATCTAAATTGCTGCTAAAAATGGATCAAATGACTACCACAAGCAAATAAGGTGGGAAAT

FIGURE 3BBBBBBBBBB

ATTAGCTTCTCCCCTAATTTATATATTTTATTCTGTGGAATAATGAATCCATTAAATGTT
[T,A]
TAAAGAAACAATAATATGTTACAAATAAAAGATTTACTTCTAAACATCTTACTACATGTT
TAGAAGTAGTGTATTTTATGCTTTAAATTTTAAAAACTAATATTTTTCAGCTCTTATTAT
GTACTGTGTATGTAAGACATTATCAGAGATTCTGAATACCTATCTCAGCTAATTTTGGCT
CTACTCATGGACTATGTGACCTTGGGCATGGTATCAAATTCTCTGTACCTCTGTTTACTC
ATCTATAAAATTCTCTGTACCTCTGTTTACTCATCCACCTCATACAATTATTATAAAGAT

650235 CTAGGAGAAATTAATAAAGAAAGCAAGAAGGATTTAATTAAGTAAGGAAATCAGCTCAAA
ATATGCTCAGGGAAAGATGGCTGGGAGCAAGAAAAGTGAGTGGAAGGTGGTGCTATCAAT
TGAAATAAAGATACAGAGGAGGAACAGGATGGACTGGTAGTTGGAAAGAAATGGTAAGTT
TAATTTTGGTCATGTTGCATTTGAGATGTCTGTGAAACATCCACTGAAAATGTTCAGTGG
GTGGGGACCAAGATGGCTGACTAGAAGCAGCTATGGTGTGTGGCTCTTACAGAGAGGAAT
[G,C]
AAAGAGGTGAATAATACAGAACCTTCAACTGAAACATCCAGTACTTGCACTGGGACTGAT
CAGGGAAACAGTTTGACCTACAGAGAATGGAGAAAAGAAGGTCAATGACCCACCCAGGAG
CAACACAGAGCAACGGGAACCTCCCCTACCCTGGGAAGCAGTTAGTGAATGTGTGACCCC
CGGAAACCACACTTCTCCCATGGATTTTTGCAACTCTTGGGTCAGGAGATGCCCTTGCGA
ACCCACTCCACCAGGGTTTTCAGTCTGACACACAGAACTGTGTGAAGTCCTGGCAGAGAA

650543 TGAATAATACAGAACCTTCAACTGAAACATCCAGTACTTGCACTGGGACTGATCAGGGAA
ACAGTTTGACCTACAGAGAATGGAGAAAAGAAGGTCAATGACCCACCCAGGAGCAACACA
GAGCAACGGGAACCTCCCCTACCCTGGGAAGCAGTTAGTGAATGTGTGACCCCCGGAAAC
CACACTTCTCCCATGGATTTTTGCAACTCTTGGGTCAGGAGATGCCCTTGCGAACCCACT
CCACCAGGGTTTTCAGTCTGACACACAGAACTGTGTGAAGTCCTGGCAGAGAAGCTTTGC
[A,C]
GATTCACAGAGTCCTGGGAGCTTTATATACGTGGGCTCTGGGGTCCCCGGCAAATGTGAC
AGTGACTCAGGCAAGGTGAAAAGTTGGACCTCCATACATAGCCCTGAAAAGGGAGCTGAA
TCCAGGGGGCAGAGCAGCATCGGTCTGCAGGCCCCACCTCCACAGTAGCCTACGGGATAA
GACCTACTGGCTTGAAATTCCAGCCAGCCCCTGGTGACATTGTTGTACCTACCTGGGACA
GGATAGAGTTCCTGGGGGGAGGGGCAGGCCTCCATCTTTATTGTTTGGACAACTTAGCCA

650779 CACTCCACCAGGGTTTTCAGTCTGACACACAGAACTGTGTGAAGTCCTGGCAGAGAAGCT
TTGCAGATTCACAGAGTCCTGGGAGCTTTATATACGTGGGCTCTGGGGTCCCCGGCAAAT
GTGACAGTGACTCAGGCAAGGTGAAAAGTTGGACCTCCATACATAGCCCTGAAAAGGGAG
CTGAATCCAGGGGGCAGAGCAGCATCGGTCTGCAGGCCCCACCTCCACAGTAGCCTACGG
GATAAGACCTACTGGCTTGAAATTCCAGCCAGCCCCTGGTGACATTGTTGTACCTACCTG
[G,A]
GACAGGATAGAGTTCCTGGGGGGAGGGGCAGGCCTCCATCTTTATTGTTTGGACAACTTA
GCCATTTCAGTCTCTGGGCTTTGGAGAGTCCAAATTGACCAGGGATAGAAGGGATCCCCC
AACACAGCACATCTGCTCTACCAAAACATGTCCAGATTGCCTCTTTAACCAATGTATTCC
TCCTCACTGGTGGGGCATCCCAACTGGGCCCTCCAGCCACCCCCTCCTGTGTTCTCCAGC
CCAACAGAGATTTGAATTCTCCCTGGTATGGAGAGCCCAGAAAGGGGTGGGCTGCCATCT

661781 TTCCCCAAACTTGCCAGCCCTCATCTTGGTCCTGGAGAAAAATAATTAACTAATAATGCT
GAACATTCAGCTGATGCTGAAGAACATAAATGTGTTATGGCAGTGATGTGCATGCTTATG
TGATTTTCTACATGAACACTCAACTCCCCAAATGTAAGAGTGAAGATAATAGAAACTATG
GTTTGTAGAGCATGTACAAAAGAAAAACAAGGATGCCAAAAGGGGACTGAGGATGGTAGT
GAAGGGATCATTCAGGTAACAGACCGTGAGTCCATGCTAGATAAAGAAGGAAATAAAGAG
[C,T]
CTAATAGACTAGAAAGAATCGAGAGTATATGGGCTAGAAGTCTTTATTGCATAGATGAGA
AAGTATAGTTTTGTATGAGGGTAAGAGAGGAAGGGAAAGAAGAATGTGGCCAGAAAGTAG
GGTACTGGCAGTAGTGTGCTAAAGCCAGATCATACCAGTTTGCAAGAGCTGGTTGATAAA
CTATTAGTAGCTTAAAATTTGCTATGTTGGGAGTAGTTACACCACAGGAATTGGCAAATG
CTACAAATCAGGGCTTTCTGTCTTATTTTTTCTCTGGAGAGCAGGTTTACCACCATAATA

662268 GTAGCTTAAAATTTGCTATGTTGGGAGTAGTTACACCACAGGAATTGGCAAATGCTACAA
ATCAGGGCTTTCTGTCTTATTTTTTCTCTGGAGAGCAGGTTTACCACCATAATACTAGGT
TGATGTTTAAGATTTCTAAAGTGAGGCAGTTTTAGAAATGACAACTTCCAGATGTCCATT
TGGGAGTCTGTGGCTGAAATAAAGATGAGATTAATATACTTAATAAACTAATGTAACTAA
CATTTACATGTGCTTTCTATGGGTCAGTCATTATTCCAGTCCCATGCATTAGCTCACTTA
[T,C]
TGTTTACAACAGCACTGTGAAGTAGTTATTACCACTATCCTCATTTTACCAGTGACCAAA
CTGAGGCAAGGCAAGTTAGGTGGCTTGCCCAATGTCAAACAGCTGATAAATCATTTATTC
ATTTGTTATGCAAATATGTATTGACAGACTACAGTAGGCCAGGTACTTTTCTGGATCCTG
GAATACAGAAGTAAGCAAAAGAGAATTAAAAAATTTAGTGGGTAGAGAAAAAAGAATTCA
GCAAAATATATGGTAAGTCAGATGTTATTATTGCTGTGGAGAAAAATAAAGCAGGGAAAA

FIGURE 3CCCCCCCCCC

662994 GAAAATATTCCAGGGAATAGTAATAGCAAGTGCCAGTTCTCTGAAGTAGGAGCATTTTAT
TTCTACAGAATGGCAAATAAGTATTTATGCTTGATGAACATAATGCCTGTTTTTCCTAAA
ACAATGCCAAATTATGCATGTTATCCCTTCACAATTATTAGCATGAGCCTTTTACTCTGC
AGTTAGAATAATAAAATATATAGTCACCCTATCACTATGGCTAGAGAAGATTATGTAAGA
AGAATAGTAAAAGATAAAATCAGAGCAGATGGAGACAGAAAGGGAAACATCTCTTGGACA
[G,A]
CAATGATTCTCATATTTGGCTATATATTATAATAATTTAAATTTGAAGACCTTTTAAAAA
TCTCAAGTTCCAGGCTTTACCCCAGACCAATGAAATCAAAATCTCTTGGGATGGGACATA
TGCATCAATATTTGTCAAAAGTTCCCCCAGTTGAGTCCAATATGCAGCCAAGTTGGAAAA
CTACTGAAATGAGGCCTAGTAGGCCATTATAATGACTTTGACTCTTCTCTGAGTAATATG
GGAAGCCACTGTAGTCTTTGGAATAGAGGCATAGCATGATGACCTAATTACTATATTTTA

663470 GAAAACTACTGAAATGAGGCCTAGTAGGCCATTATAATGACTTTGACTCTTCTCTGAGTA
ATATGGGAAGCCACTGTAGTCTTTGGAATAGAGGCATAGCATGATGACCTAATTACTATA
TTTTATAAGGATCACTCTGTTTGCTGTATTAAGAAGAGACTACAGTGAGGCACAAATAGA
TGCAGGGAAATTAGGAGGCTTTTGCCATAATCCAGGTAAGAGATAATGATGCTCTAAACT
AGGATCGTTGCAGTAGAGTTTATGGGAAATGGTCAAAGTCTATGATGTATGTTAAAAGTA
[G,C]
AGCCAATAGGATTTGCTGATGGATTGGATAAAGTGCATAAAAGAAAGAGAAAATCAAGGA
CAACATTTTACGTACAAAATAAGTTCAATGATAGGCAATAACTGTTTCCTAAGGTTATTG
CACTACAGTATTAAATGGCTAATATACATAAAACTCCTAGAACAGTGTCTGCCACATAAT
CAGGTATTCATAAGGTCATCTATTATTATTATATTATATTTCAGAAGATATCACTAAGAG
TCATAAAATTGTCTGTTACTTCCTGATCTGTTTTTTCAGGTGGCTAAAAATAGTTTCAAT

664153 GCAATGTGAGACATTTGAAGAGTTTCCTTGAGCAAATGTGAAGCAAATATTAATTTAAAA
ATTAAAGAGATCTTTTAAATATTTATGTACTCAAATTATAAATCTAGTAAAGATGGCATT
TCACCTTATACTAGTTATTTATTAATAATGAGAGCTGTATTTTATTAGCACACTTTTCTT
GTAAATTGTGTGCATGTGGTTATATTTGTGCTGAGGTAGAAAAGTGAAATTAATCTAAAT
AACACTCATTTTATATTCAGCAGTGGAAAAGAAGAAAATTGCATTTACCCACCAATAACT
[G,A]
TTTGTTTGTTTGTTTATTTATTTATTTGGAGCCTTTATTGCCCGGGCTGGAGTGTAGTGG
CGTGATTATAGTTCACCGCAACCTCAAACTTCTGGGCTTGAAATTCTCCCAACTCAGCCT
CTTGAATAGCTGGGACCACAGGCATACACCACCGCGCTAGCTAATTTTTTATTTTTGTAG
AGATGGGGTCTTACTCTGTTGCCCAGGCTTGTCTCAATCTCCTGGCCTCAAATGATCCTC
CTGCTTCAGCCTCCCAAAATGCTGGGATTAGAGATGTGAGCCACCATGCCTGGCCAACTG

664687 GATCCTCCTGCTTCAGCCTCCCAAAATGCTGGGATTAGAGATGTGAGCCACCATGCCTGG
CCAACTGTTTTTAAGCCATAAAAACTATAGTTGAAACACACCTTAATTACATTTTTAAGA
GAAAAATAGGTTAAACTTCATGCAGTAGAATGTTATCTTTTACTATACCTGTGTCAGCTT
AATGCTAAATACTATTCTAAAAATAATGTGACATCAGACATGCACATATATGAGAGCATG
GTGTGCTTAGAACCAAGCATATGGTATGGATGAGTGAACTTTTTTGTAAATTAGGAGTTT
[G,A]
AGCAGCAATATTCAATAGCATGAGTATACCTCTTTAAACACTGTATTAACTGATACCATG
AAATTATAATTTATAATTCTCATTAATTCTTCTTTTGCATACAAAACTTGACATTGATCT
TTTGATTGTATATAATGTAAAATTATATATAAAGAAATTCTATGTATTTTTCCTGAACTC
CTCTATGGTCACTCCTATCCCTTTGTTTGTACCATTTATGAGATATTGGATTTACAGAAC
TGAATATTAAACCCTAAATTTATAATTTAACCATGCTCAATAACCAGAATCACCATCTTA

667140 GTATTTATTGAACCAGATTTGTGAGGAATCTGTGAAATTTGTTTATTGTAGGTACCCATG
ACACCACATTGTGAAGGGTATCCTCTAAATGTTTGTAGAATCAGTGACATGCAATTTTTG
TTAATTCTCCTCAAGAATAGCAGCTTATCATCTACCAGTTATAGTGTCATCTACCATCAT
ATTTAACCTTTTAAGGACACTGAATCGCCAGAGTTATCTGCTTTAATAATGCACATTTTT
CGGCAAGAAAGTTTGAGGGCAGTGATTTATATTATGGTCCATAGATCTTTGACAGTTTCT
[G,A]
AGCTATTCGGTTGGTGGGCTTGACATCAGTGATTCTCCATTGAAGATCTAGAAAGAAATA
TAGCAGATATCTATATAAGATATTTAGTTCCCTTTTCCTCACTCTTCAGCAAAAATATAA
AAATTTTGTAGTAGTCATAATCAGAGTCTTGTCCTCAAAAGTGGAGACGGCTGCAAGTGT
AGTCAACACTTCAGTACTTCTTGGTCATTCGTGATCTTTGCAGAGAATCTCCTATAGTAA
ATATGACTTTTCATTAAAAATACATCAAGAGAATATCTTACCGCATACTGAAAGTTTGAA

667721 CCGCATACTGAAAGTTTGAAAAGCTTCACTCCTCTAAGAGAAAAATAAATGAATTCAGTT
TAGTTCAATTTAGTGAATATCTATTAAATATCCACTGTGCCAGGCAAGGTGCTAGACCCT
GGGATTACAAGGGTGAACAAGACAAGATATGCTCATTGTTCTCGAGATCATGTTCAATCC
AGTGGGAGAGAAAAACACATACATATTTGGTTTTAGCCAAGGTTTGAGATCTATTTTAGA
GACAAAGCCAAGTTGGACCAAGTTCTTCTCTCTATTGCTCTCAAATCACCCTTTTTTGCT
[A,T]
CCCACATTGACTCCTAGCACCTAGAATTACAGTAACTGGCCCATAGGATACTCAGGGAGT
GTTGTTAGAAGGAATAAACTTGAGGATTCAGCAAGGGCCTCCTGGAAGAGATAATACGAG

FIGURE 3DDDDDDDDDD

TCACAAAAAAACTCAGGTGACAAAGACTAGAATGACCTTCCTGGAAGAGGAAACTGTATA
AGCAAAACACATTAGATATAAAACAGCATGTTCTAGGGGTGAATTGAGCACATGCAAAAA
ATAAATAAATAAAGCAGAATAAGGGTATGCAACTGAAGATATGAGCAAGGGTCAGGTCTT

669600 ACTCCAATAGATAAGAATACAGGCTCTGTCATTGCCTGGATTCAAATCCGGACTCCACCA
CTCACTAGGTTATTAGATCTCTTTGTCCTCCAGTTTCACCATCTACAAGATGAAGATAAT
CACTACGTTTACATCACATCAATATTGAGAGAATGAAATAAAATAAGACCTGTAAAAACC
TTAGTCTGGGACTGGCTTATCGTGTTCAATGAATGTTAGCTATTTTTCTCCTATAATAAT
GTGGAAGAAATTATCAGATGCATTCCCAAAAGCATATAGAACTATTTGTAGAGCTTTTTT
[T,C]
TTTTCGTCAAGCCCACATTTTATAAACAGTAGATAGACCAATTGGATCGTGGATAAATAG
ACAGAAGATTGTAGTGATAGAGAGATAAAATAACACAGGTGGGGTTCCCTGGGAAAGATT
GTAAAAAGATGTGCACGCAGGAACTTTGTTGGGAGGGCTCACAGGACCAGCTTCCTTATT
CCTATAGCTTCCAGAGTTTTGGAAGCTGATAGCCCTTAACCGAATCACTCCCTAGGGAAT
GCTCTTGGCTAAAGAAAGCTACCTCACCCAAGGCCATGACCCCTTTACACGAGCAGCCTG

670169 CAAGGCCATGACCCCTTTACACGAGCAGCCTGAATCCAGTGATTGAGGTAGGACAGGGGC
CCAGTCTTTCTTTCCTCAGTTTGAGCCAACTCTGAGGAGTTATCCAGAACATCCCATAAA
ATAGATGAAGGCCTTTGGGTGAAGGCACTGAACTGTAACCTGCTGCTGCCCAATCCTGCT
TTCTTCTCTTCCTCAGAGGTATTGATGCTGAGAGTGTCTAATCAAAAATCATGATTTAAT
GAAACTCATAAGATTTACTGCTTCACCAAGGACATTCTTAAGAAAACCTAGCTTTTTTTT
[T,-]
TTTTTAATCTTTCTGTGAGTGCCTGTGTCAGAGAAGAATATGAGAATACTAGTATAGCTT
GGTTTGGTGCTGACTTGATTCCTGATAAGACTCCTGCAGTTTTACCCATCAGAGTTTTGT
ACCATTTGTGCAAATATCAACCTAGTGAAAAAAGGCAAAAACATGTACTTAGTGCTATTA
TGAAAATAATTTTGACCTCATGGACCCCTGAAAATGTCTTGGCCAATGGATTAGAAGTAA
ATATCCTACATTTATAGTCCTATAAAAGAACATAAAGAAAGTAGTTTAGATTCTTTTAAT

670488 GTGCCTGTGTCAGAGAAGAATATGAGAATACTAGTATAGCTTGGTTTGGTGCTGACTTGA
TTCCTGATAAGACTCCTGCAGTTTTACCCATCAGAGTTTTGTACCATTTGTGCAAATATC
AACCTAGTGAAAAAAGGCAAAAACATGTACTTAGTGCTATTATGAAAATAATTTTGACCT
CATGGACCCCTGAAAATGTCTTGGCCAATGGATTAGAAGTAAATATCCTACATTTATAGT
CCTATAAAAGAACATAAAGAAAGTAGTTTAGATTCTTTTAATACACCAAAATCTTATTTT
[T,A]
AAAATGATACCACTTACCATTATTAGAACCGTTATTACCATGATGATTGAAATGAAAGCA
GTTAATCTAAATCTTCAAATGTTGGTGACAAAAATATTTTAAGGTTAATTTTTAAAATAA
CTTGCATAATAGCCAAAAAGTAGAAATAAGTCAAATATCCATCAACTGATGAATACACAA
AAAGAGTAGAAATTATCCAGCAATAAAATGAATAAATTACTGATACATGCTACAATGTGG
ATGAACCTTGGAAACATACTAGGTGAAAGAAGACAGTCACAAAAGACCACATATTGTATG

672011 TCTTGCTCTAAGAGTGTTTTTTTAAGAGAGGGTTCTTTCCCTTACTCTGCACTTGAGTTG
GGAGATATTATCAGAGAGCTATCAGAGAGATAAGTTGATAGAGCAAGACAAAGTTTATTT
CATTTGTAGTATAAGCTTATTCATTTACCTGAACAATGAATCATCATTGTATAAGAGACT
GTGTCACCATGACAGCTAGGGTAAGATCATCTCTGTCCTGAAGCTGCACTATGGTTTGAA
ATCAGATATGTATTCATAAAATCTGCTTTAACTTTTAAAATTTATAAGTTTCTCTTATTT
[A,G]
TGCTTCTAATGTATAACATAAAGTAATATAGCCCTACAATCTACTGCTAGATATTCATTT
TTAATATCATTCATAAATAAATGTTGCATGATGTATAAAAAAAAGAATTTTTCATGTTGC
TCTATAACTCCATTAAAGACAACAATCTCCGAATAACTAGGTAGAATAATATGCATTATT
TTTCACACTTAAAATATTTTTATTTTTATTTCCTCTAATTTCAAGGGTACTATTTGTTTA
CTATTTGTATCTGGTCTTGTTGGTGCATACATTTTGCTCAGATAACAATTGGGTATTTTT

672608 TTTTTAACTCTTTAAAATGAAAACATTATTTTAAAATCAAGGTGGAGGGAATAAGATGGG
ATTGATTAGTTAAATGGGATTGATACTGATACCATGCCTGACTCATTCTCCACATCATTT
AATTTAATCCTTCCAATCAGGAGCTAAAATTGTCTCATTTTTCTGTCAATTGCTAACAAC
TTTTCTGTCTTCCCTGTATAATGAAAAAAATGGAAAACTCTATTTCTTTTCTGTTTGCTT
GTGCTTTTTTTCATTCTGCTGCTTTCCTATACTTGTTTCTTGTTTATACCATCACTTTTT
[T,C]
TTTCCTGAGTCACCTGTCCTGACTACTATTTTTCACAGTATCTCCAGTTATCACACGGGT
TTTATCCAGTCCTAGGTTTTGCTGCCCTTCTACCCAGCTGTACAGCTGGTTCAAAGCTCA
CAGCTATGGAAAGTGGATTCTATTTGTTTGGTAGCCTTTTTTTTTGGCAGACTTTGCTCTT
ACTTTATTTCACTTTAGTTCTCTCCTATTACCTAAGCTTTTGAAATAATTTTGTTCTGAG
AGTTAATTTGGTTGGTTTCCTTCTGTCCTTTGTTTAGTTGTCCTTCACTACTTCCAGTTA

674197 ATAGTGTAAATATTTCTGACTGTCCTAAACCAATTCATTTCACTGATCTCCTTGGTTATT
GTTTTGAGAAATTTGGTCTCAAAGTCTCTGTTGTGCTATCTTCAAGCTACTAATTCATAA
AGTTATATTCTGTTATTTTTTTAAACAAACCTTCACCACTAACTCATTTGGCAGTCAGTT
TCAATGAAAAATAAGTTATTAAAGCTACTCAAAAGATTTTTATTATATTCTTATTTTCTC

FIGURE 3EEEEEEEEEEE

ACTTTACACATTATTTTAAAAGATGCAACTTCATTATTGAGTCCTTTTTTATTTCATGCT
[T,C]
TATGAGTTTTTTTGAAACTTTGCTGTATTCAGTTACTCCAGAATAAAATGCAAGTTTAAT
ATTGTGAAAGGAATATTTTATGCCTTGCTATATTTGCTTTGTAGAAATGTTATCTATTAA
TTTATCAATGATATTTTTCACAGTTTCTTCAACAAAGAAATATAGTTCTAAGGAAAATAA
ATTAACCTTTCATTGTCTGATATATAAAGTAGCAGTGTAGGAGTATCTACTGATCTTTTA
ATTTAACCAAAAAGCTTCATAAAAATAAAAGTCTATCAGTTCTGAAAACAATTTGTGCAG

675175 TGTAATATACTCATGAAATTGGCAGATAACTGAAATTTTTATGCATACGTAAGTTTTGTT
ACATCAAATTTAACAACCAGACTCTTGGCATTTTCTGTCTTATGTGATTCTAAAGACTAA
GAGGCCTAGGACAGTGCTTTTTAAAATTTAGATTGGACCCCAGACTTAAATAGCAAATTA
GGTAACCAGAATATTAACACTCTAAAAACTGCCTTTGAAAAGCTGTAGATTATGTCTTGA
TTAAGAAATAAGTCTCTGAATTTAGAAGGTATCAATTAAATGGCAAATAATATAATCAAG
[T,-]
TTTTTTTTTTTAAGTCTCAGAACTACTTACTGTTCAGAGGACTGACTTTATAATGAACAT
GGACATTCAGCACTTAAAATAGTAAAGCTCTTGCCTTTAAAGACTTTATACTTTCACAGG
TTAGAAGGTTCATGCTGCCTTGCAATTCAATACAGTAAGTGTGGTCATGGGGGTCTTAAA
AAGAACTACAGAAGTACCAAAAAGCAGAGGCTGAAGAAGGCGTCACAAAAAGTCAAAATG
TGAACCAAATCTTAGGAGAATTTATTACGCTGACAGTTGGAGGAAAGGTAGTCCAGATGG

675186 CATGAAATTGGCAGATAACTGAAATTTTTATGCATACGTAAGTTTTGTTACATCAAATTT
AACAACCAGACTCTTGGCATTTTCTGTCTTATGTGATTCTAAAGACTAAGAGGCCTAGGA
CAGTGCTTTTTAAAATTTAGATTGGACCCCAGACTTAAATAGCAAATTAGGTAACCAGAA
TATTAACACTCTAAAAACTGCCTTTGAAAAGCTGTAGATTATGTCTTGATTAAGAAATAA
GTCTCTGAATTTAGAAGGTATCAATTAAATGGCAAATAATATAATCAAGTTTTTTTTTTT
[T,-]
AAGTCTCAGAACTACTTACTGTTCAGAGGACTGACTTTATAATGAACATGGACATTCAGC
ACTTAAAATAGTAAAGCTCTTGCCTTTAAAGACTTTATACTTTCACAGGTTAGAAGGTTC
ATGCTGCCTTGCAATTCAATACAGTAAGTGTGGTCATGGGGGTCTTAAAAAGAACTACAG
AAGTACCAAAAAGCAGAGGCTGAAGAAGGCGTCACAAAAAGTCAAAATGTGAACCAAATC
TTAGGAGAATTTATTACGCTGACAGTTGGAGGAAAGGTAGTCCAGATGGAGAAGAAGAAA

675386 CCTTTGAAAAGCTGTAGATTATGTCTTGATTAAGAAATAAGTCTCTGAATTTAGAAGGTA
TCAATTAAATGGCAAATAATATAATCAAGTTTTTTTTTTTTAAGTCTCAGAACTACTTAC
TGTTCAGAGGACTGACTTTATAATGAACATGGACATTCAGCACTTAAAATAGTAAAGCTC
TTGCCTTTAAAGACTTTATACTTTCACAGGTTAGAAGGTTCATGCTGCCTTGCAATTCAA
TACAGTAAGTGTGGTCATGGGGGTCTTAAAAAGAACTACAGAAGTACCAAAAAGCAGAGG
[C,T]
TGAAGAAGGCGTCACAAAAAGTCAAAATGTGAACCAAATCTTAGGAGAATTTATTACGCT
GACAGTTGGAGGAAAGGTAGTCCAGATGGAGAAGAAGAAAGAAAAAAGACATGGAAATGC
AAAAAAGTGAATGGGCCTATCGATGAAAATTTGGGGCCATAGGCAATGGAGGGGCCAATT
TTCCTGGAATAAATGTAAAGGTACCTGAGTGGCACTCCAAGAAATTTGAAGGTTTTTGTA
TAGCAACTAGGAGACAGGCACTGATTTATTTAAACAGGAAATAACAAACATAGACGCATG

675415 TTAAGAAATAAGTCTCTGAATTTAGAAGGTATCAATTAAATGGCAAATAATATAATCAAG
TTTTTTTTTTTTAAGTCTCAGAACTACTTACTGTTCAGAGGACTGACTTTATAATGAACA
TGGACATTCAGCACTTAAAATAGTAAAGCTCTTGCCTTTAAAGACTTTATACTTTCACAG
GTTAGAAGGTTCATGCTGCCTTGCAATTCAATACAGTAAGTGTGGTCATGGGGGTCTTAA
AAAGAACTACAGAAGTACCAAAAAGCAGAGGCTGAAGAAGGCGTCACAAAAAGTCAAAAT
[G,T]
TGAACCAAATCTTAGGAGAATTTATTACGCTGACAGTTGGAGGAAAGGTAGTCCAGATGG
AGAAGAAGAAAGAAAAAAGACATGGAAATGCAAAAAAGTGAATGGGCCTATCGATGAAAA
TTTGGGGCCATAGGCAATGGAGGGGCCAATTTTCCTGGAATAAATGTAAAGGTACCTGAG
TGGCACTCCAAGAAATTTGAAGGTTTTTGTATAGCAACTAGGAGACAGGCACTGATTTAT
TTAAACAGGAAATAACAAACATAGACGCATGTCTTAGAAGATATTATTGGGGCCGGGCAC

676698 AACAAAATTATAATAGACAGATATTCTGTCTCAAAGGCAAGATAATGCCAAATGATCATT
GGCATTCTGTCAAAACTTTGTTTATAAATTTTAGAGCATTCTATGAATGTACTTAGCCCC
CAAATACTTTTCACATTTCCTCTTAAAAAGAATGAAATAGTTAGAAACCTGCCTACTGAA
GATACAAGTCAATTCAAGCAAACCCTGTATAATAAAATACAGAGGAAGAATGGTCATTTA
TATGAAAAGGGTGGGGGAGGAGCCAAGATGGCTGAATAGGAATAGCTCCGGTCTACAGCT
[A,C]
CCAGCGTGAGCGACGCAGAAGACGGGTGATTTCTGCATTTCCATCTGAGGTACCGGGTTC
ATCTCACTAGGGAGTGCCAGACAGTGGGCGCAGGATAGTGGGTGCAGCGCACCATGCGCG
AGCCGAAGCAGAGCGAGGCATTGCCTCCCTTGGGAAGCGCAAGGGGTCGGAGTTCCCTTT
CTGAGTCAAAGAAAGGGGTGACGGACGCACCTGGAAAATCGGGTCACTCCCACCCGAATA
TTGCGCTTTTCAGACCGGCTTAAAAAACAGCGCACCACGAGATTATATCCCACACCTGGC

FIGURE 3FFFFFFFFFFF

681534 TGCGAGGGCTTAAAAATAAGAAGACATGATAGATAAAGGTTGGGTTTTGTGGGGCAGTTG
TTGGGGAGAGGTTTGTAATCTTCAAGAAAAAAATATCTTTAGAACAGTATGCTACATGGA
AGCTATCCTTTTCTAATCAAAATACGGACAGAATAGGCATTTTCCATTAAAATGACTTTG
CCAATTCAGAGACCCACAAATCACAACAAAGAGCAATCAGAACTGGTTAAAGAAGATGGT
CTGGAAAGCTTGTGTGAGCAGTGCGAGTCCAGCTCTGGTTATGGTACTGGACTGGTCCTC
[A,G]
TGTGGAAGAGAAACAGAAGGGCCATGGGAGCCAGTGGCCAGACCAGAAAGCAATGTGACA
AGAGAGATAACCCTCCAACAGTGAGTCTTTCAGAGCCCCGTTTAAAAATCCTATACATGT
AATATATAAGACAGTATTGTCCACATTTCAAAATACACTAAAGTAAATGAAGAATGAGAT
TTACACCTAAATATAAGTAGAAATTCTAATATTTTCTTCTTCAACTTGAGTGTTTTGCAT
GCCGTGCTCTAGGTCTGACATATTCATTCACTGTGTACTTTACACAGTTTATTATAGAGC

682005 AGAATGAGATTTACACCTAAATATAAGTAGAAATTCTAATATTTTCTTCTTCAACTTGAG
TGTTTTGCATGCCGTGCTCTAGGTCTGACATATTCATTCACTGTGTACTTTACACAGTTT
ATTATAGAGCGACCATATTTCAGGCACTATTCTTTGGAGGGCCAATTGTGAAACAGCTTC
GCTAATTATCAGTCCCAAAAAAGGACTCCCATTCCATGAGGAAAACAGCAAAAGATCAAT
CATCACTATGCCAGCCACCAGAAACAGGAGTCCATATGTACTTATGCCCACTGCATCCTG
[A,G]
GCTACTGTGTAGGTCCACCATGCACTGGGTACCTATTTGCCAAAATCCAGTGAAAGAAAA
CATATTCACAAGTTATGTGAAATGGGTTTACTTCTTATAGATAATTAGCAAGGGACAGAA
GTCTTGGATCCATTGTGTGTGGTTCCTCCAAGGCTGAAGAAAGCTGAACAGGAAAGATGT
AGTCTTGATATGAATGCTCCACTTTCACAGCTGAGGGACCCTGAAAGGCAGTCCACTCTG
GATTATGTACTTCAGGGGCCACATGACATACTGGGCAAAGCTGTAAAGGACATCCAGCTT

682596 CATCCAGCTTCCAGGGAAGAGAGGAACAAAACTCAGTCTGTCCCATGCAGTTCCTTCGTA
ACTCAAGCTATTCAATTTCCTAGGAGGGACAGGTTTCAGGCAGTTTCTCCCTATCTGAGG
ATATTGCATTCCCAGCACATTGTACTGTTATTCTTCAGAACTACAAGCAAGAAAGCAAAG
AGAGCTGGGTTGGTCCAAGGCCACTCAAAGAACTCTACTGCACCACCAACCAAAAACAAA
GGGATTATTGAGAACAGATAAATGGCTACACAGGAATAAGACCAAGGGTAACCAAATAAG
[T,G]
CATATAGTAAAACTCATATATTGTACAGACACCAAGAGTCGACAGCACAGCATGAAAGGC
AACAAGAGTTGTAGCAGAAGGTTTTTCTGGTATAGTATGTAAGCCCTGAACTAAAATACA
TCAAGCTTTTTCAAAGAAACTTTAAGATCTGATAATGGCATGAAAACCAAGAAATGTGTA
TTGTGGGCCAAGATAGAAGGAAATAAATGCACAAAAATAGGATTTAGATGAGAACTGAGG
CCTTGTTTTTACATGCCAATTCTATGATGAGATTACAAAGCACTTATGAGAGATTAGTGA

683691 AAATTTTATGAGTCCTTGATTTTAACTTCTAATTGCATCGATTTTGTGTTATCCATGGCA
AATTTTGGTTTTGTTTGTCTGACAGCAGCAATTCAGTCGAAATACTTTGTTGAAATACAG
AGCCTCATTATTGACAATATATAATCTGCATAATTACAGTTCTGTTAACATCTTAATTCT
GTTTACTTTGCATTCATAGGACCTCTTCCAAACTCTAACACTTAACCTCTGCTATTCTGC
ATAAATTCTGAGAAAAGCCAAATTTTCTGTCGGTCTAAGAAGACATAGCCTACACCCAAC
[-,A,T]
GGAGATAATTATAAAAAATAATGAAGCAGCATGAGGGGAAGGTATTTAATGTGTATTTTA
AAGTTGGGAGAGATTCTCCTTCACCTAATTTAGGTGTTTGTGAATTGGCTTGACTTTTTG
AAGTTAATTTTTAAGCCTTGAACATGTCCAACTTTAAGAATAAATATTTTA
ACACAAGTGAGATCTGCCTTTAAGTACTTTCATTAACATGAGTAAATGGGATTCGTCTGG
AGATCATGCTTAACCTTTTAGTAAAACATACTCAGAACTTTCACTCACTTTGTCTCTTAA

686990 GAGGGGGAAAGTCTCTAAAAGCATATTGAACACAAAAGGATATCTATAGCCTGGATAAGA
TCCAATAAAAATGATTTATAAAATCACAGAATACATAATATTTTAATATTTATAAATATC
TGCAATACATCTAGTCCTTCTAACCTAAGTGCTAATCAGTGAGGAATAATCAAATGCCAG
TCACAGTTCTCAAGATATTTTCCGTACAGTTTGATGATTAAGAATCTCATGAAATGCCAA
GTGCTGTTTGTTCGTGTGTTAGCAACATTCAGCATTGTCTAATTCAGAGAAACTCTCCCT
[T,G]
TTCCCATGATTTTAGAACAAACCCAGACTATATTGATTTACTGAGAAAGATCAATCAGCA
CATGTCCAGCAAGCAGAGAGTAAAATGTCATTGGCCCATCTTGCTTGTACAGAAAAAAAG
ACAAAGTAAAACTATACACAAACATGCTGACTTTATTTTTTTTGTAACTTTTTTTTTTAG
GTTCAGAGGTTTATGTGCAGGTTTGTTGCATGGGTAAATTGTGTGTCACTAGTGTCACTA
AAGTTTGGTGTATAAATGATCCCACCACCCAGGTAGTGAGCATAGAACCCAATAGGTAGT

687337 AAGATCAATCAGCACATGTCCAGCAAGCAGAGAGTAAAATGTCATTGGCCCATCTTGCTT
GTACAGAAAAAAAGACAAAGTAAAACTATACACAAACATGCTGACTTTATTTTTTTTGTA
ACTTTTTTTTTTAGGTTCAGAGGTTTATGTGCAGGTTTGTTGCATGGGTAAATTGTGTGT
CACTAGTGTCACTAAAGTTTGGTGTATAAATGATCCCACCACCCAGGTAGTGAGCATAGA
ACCCAATAGGTAGTTTTCAACCCTAACCCCACCTCTGTCTAGTAGTCCCGAGTGTCTATT
[C,T]
TTCCTTTCTTTATGTCAATGCATACTCCATGTTTTGCTCCCACTTAAAATAACATACCTG
CTGACATTAAATCTAGAGTTTCAAAGATACCAACAGAGGAAATAAAGTCATAACTAATGC

FIGURE 3GGGGGGGGGGG

TTAATCGCTAGTTTCATCTCTGATGTGAAAAGAATGCTTTTGTCCTTCAACAGTAAACAG
CTAAGAAGGAAAACATGATAAATACCAGACAAACCACATGAAATCTTTATGGGAAAGCTT
ACTTATTCCCAGTGTAAAAAGCTTCACATCAATGGCAAATAAAGTGAAAACATTACCGGT

689158 TGGTAATGTAAATTGGTACAGCTATCATGGAAAACAGTCTAGAAGTTCCTCAGAAAATTA
ACGATAGAATTACCATATGATTCAGCAATCCCACTTCTAGGTATATAATCAAAGGAAATG
AAATCAGTATCTTGAAGAGATTCTGCACTCCTGTGTGTGCTGCATCATTATTCAAAATAG
CCAAGATATAAAAACAACCTAAATATTTCTTTTTGAATGAATGGATAAAGAAAATGTGGT
GTGCGAATTATCATTCAGCCCCCAAAAAGAAAATCCTGCCATTTGCAAAACATAGATGAA
[T,C]
GTAGAGGACATTATGCTAAATGACATAATCCAGAATCAGAGAGACAAATACAACATGATC
TCATTTACATGTAGAATCTAAAATAGTCTCATAGAAGCAGAGTAGAATGGTTGTTACCAA
GAGCTGCAGGGAGAGGGAAATGGGAAGATGTTGGCCAAAGGGTACTAAGTTTTAGTTAGG
ATGAATATTTCTGGAGAGCTAATACACAATACTAAATTTAACAATACTATATTGTATGCT
AGAAATTTGTTAAAAGGGTAGATCTTAAGTGTTCTCACCAGAAATTTTAAAAAAGAAAGG

689205 CCTCAGAAAATTAACGATAGAATTACCATATGATTCAGCAATCCCACTTCTAGGTATATA
ATCAAAGGAAATGAAATCAGTATCTTGAAGAGATTCTGCACTCCTGTGTGTGCTGCATCA
TTATTCAAAATAGCCAAGATATAAAAACAACCTAAATATTTCTTTTTGAATGAATGGATA
AAGAAAATGTGGTGTGCGAATTATCATTCAGCCCCCAAAAAGAAAATCCTGCCATTTGCA
AAACATAGATGAACGTAGAGGACATTATGCTAAATGACATAATCCAGAATCAGAGAGACA
[G,A]
ATACAACATGATCTCATTTACATGTAGAATCTAAAATAGTCTCATAGAAGCAGAGTAGAA
TGGTTGTTACCAAGAGCTGCAGGGAGAGGGAAATGGGAAGATGTTGGCCAAAGGGTACTA
AGTTTTAGTTAGGATGAATATTTCTGGAGAGCTAATACACAATACTAAATTTAACAATAC
TATATTGTATGCTAGAAATTTGTTAAAAGGGTAGATCTTAAGTGTTCTCACCAGAAATTT
TAAAAAAGAAAGGTAAATATGTGAGGTGATAAATATGTTACCTAGCTTGATTGTGGTTAT

689569 TTGTTACCAAGAGCTGCAGGGAGAGGGAAATGGGAAGATGTTGGCCAAAGGGTACTAAGT
TTTAGTTAGGATGAATATTTCTGGAGAGCTAATACACAATACTAAATTTAACAATACTAT
ATTGTATGCTAGAAATTTGTTAAAAGGGTAGATCTTAAGTGTTCTCACCAGAAATTTTAA
AAAAGAAAGGTAAATATGTGAGGTGATAAATATGTTACCTAGCTTGATTGTGGTTATGAT
TTCACAATGTATATTAAAAACATCAAATTTTATACCTTATATATAGATAATTTTTTGTCA
[A,G]
TCATATTCAGTAAAGCTGAAAAAGCGCTGGGGAGAAAACATTAAATAATCATGCTATTGG
ATAAGTAATTACAATCTGAGATTCTGTACAACAAATCTGTGAGTACCTACTGTTTTGGTA
GGTACTGTTCTGGTCACTGGACATATTCCAATAAGTAAGCTTTCTTCATACAGTTTACAG
TCTTGAGGATGGCAGAAATAAAAAATAATTTTTAAAAGATAATCTCAGATAGTGATAAAT
ATTGGATATACAACAAAAATAAAAGTGAGTAGCTACCTTGAAAGACATGGCCAGTAAATA

690706 ATATATTATATATTATATATTTTATATATATATACACATACATATATATGTTTTTTGTGT
ATGTTTTGGGGTTTTTTGTTTCTCTAGATGAGGAAATTGAGGCCCAAAGAAATGATTTAC
ACAAGTCACACGGCTATTCCATGGGAGACTATGTCAGTTAGCCATTGCAATAACAATGTT
TGGGGAAAGTGCCTGTCCCACAATCAAATCCTCCTTCTTCCCCAGTAGTTTCCACTGCAA
ATTCTTTTCTGTCATATGCAAACTCCCTTCAATCTCTTACCTCTGAGACTCTTGCAGAAG
[A,G]
CAATGGATATCGGCAGTTGAAAGTCTTTGAAGGTTGAGAAAAAAAGAGAAAGATCTCATC
ATTTTTTATGGGTGCATAGTATTCCATGGTGTATATGTGCCACATTTTCTTAATCCAGTC
TATCATCGTTGGACATTTGGGTTGCTTCCAAGTCTTTGCTATTGTGAATAGTGCCGCAAT
AAACATACGTGTGCATGTGTCTTTGTAGCAGCATGATTTATAGTCCTTTGGGTATATACC
CAGTAATGGGATGGCTGGGTCAAATGGTATTTCTAGTTCTAGATCCCTGAGAAATTGAAC

692682 TTCTTTTTATGGAAGCTGAATCATTACCTTGTTCTTTTAGTAGTCCAAATGTTTGTTTTT
CCTGTATGCTATAAAAGTAAACTTTTTAAGAGAAGTCAACATTTTAAATTTGTGTTTATA
GCATGTATTTTTCTAAAGGCTCTTTTTTTAAGGAAAATTTTCAGGCTGTGTTTCTTAGTT
AAGATGAAACTATGTTTACTTTTAAAAATAACTGCCACTAAAGGAAAAGCATAAATTTGA
TAGAACCAAGTTGTTTTCTTATATAAAGTAAAAACTAACAAAGAAGTCAAGGAATAAACT
[C,A]
TTATACCTTCATCTCCACCCTACCCTCTATAGGTTCCATAATCAAGGCATTTCAGTAGCC
CAATATGGATATGGAGTCATTAAGAAATGGAAATACTACAGACATAATATGGTAGAGTAA
ACAGTAGGTTATAAACTTGGAGCTGTGATTTTAATCTCAGCTTGGCCATAATTCAGTGAA
CAGACACGAATCATTAATTTGAAATCCTTGTACCTCGGTTTCCACATCTTGAACAGAATT
AATAAAACTGACCACTCTATTTTACAGAATGTTATAAGAACGAACAGGATAATAAATAAG

693581 AAGCAGGTAAAAGAATTGTCAATACAGTGGAAAGGGGGAGGAAATAGGAAGGAAAAGGAG
TGAATAATGGGAAATTAGAGCTGTTCTGGTTACACTAAGCATACTGTACAACATAAATTA
ATAATTTCCCTGGCATTATTCTTAGCATTATGCTTTTCTATCTCACCCACACACTTTTAG
TTTCTATTATAAGATAGTTTTTCATGTAAAACATGCTTTATAATGAAGAGTGAGACTATG

FIGURE 3HHHHHHHHHHH

AGCCCTGATTTTTTTCTCTGGTGCTCCTTTTGTTGAATTTAGTATTTTCCCTTTTGCTAC
[C,T]
TTTTTCTTGCATTTTCTTCTCTTTAATGTATCCATGACAATTATTTGTCTCCAATATAGA
CCAATGTAAAAATGTATGTCCCTTCCATGGCACTTACTGAAGACCTTAAAATTTTGTGAA
AATACTTTAAACTATGATATAACTATAACCTATGGCCAGAACATAGACAACTTTTCTTAG
ACAGTAATGTCATTCAGTTGCCTCAGGTGCTTAATTTTATCTCAGAGTCTTAAAACAATT
ACATATTATTTCAGATTATGCCATGAAACTTTAATATCTCTAAAGTCAATGGGGTTTTAA

693656 TAGAGCTGTTCTGGTTACACTAAGCATACTGTACAACATAAATTAATAATTTCCCTGGCA
TTATTCTTAGCATTATGCTTTTCTATCTCACCCACACACTTTTAGTTTCTATTATAAGAT
AGTTTTTCATGTAAAACATGCTTTATAATGAAGAGTGAGACTATGAGCCCTGATTTTTTT
CTCTGGTGCTCCTTTTGTTGAATTTAGTATTTTCCCTTTTGCTACCTTTTTCTTGCATTT
TCTTCTCTTTAATGTATCCATGACAATTATTTGTCTCCAATATAGACCAATGTAAAAATG
[T,C]
ATGTCCCTTCCATGGCACTTACTGAAGACCTTAAAATTTTGTGAAAATACTTTAAACTAT
GATATAACTATAACCTATGGCCAGAACATAGACAACTTTTCTTAGACAGTAATGTCATTC
AGTTGCCTCAGGTGCTTAATTTTATCTCAGAGTCTTAAAACAATTACATATTATTTCAGA
TTATGCCATGAAACTTTAATATCTCTAAAGTCAATGGGGTTTTAAGGCACTTGGAAACGA
TTAGGTTTTGCTTGAACTCCAATATACCTTACGGGAAATAGAAGAAACCGTGGGAATTGC

696568 AGTTTGTCATTTTTATCAATACATTTGCTCAAAGTACACTTCAGTTACAGTATTTTCCAC
TGAATTTCTAAGGTGAAATTTCTAAGGTGAATTACTTCCTATAATAAAGTGGAAAATATT
AGTTCCCTGCTCTTTTTGTAAATCCAGAAATAACATCTCTTTGTGTGGTGCTGTAGCACC
TCCAGTATCTTTCTGAGTCCTCATATTATACACTGCACTTTTCATATAAATGGAAAATAT
TGAGAAGGATTTTTGGTATTACATTATCAAGACAATTTCAGAGTGAAAAGAATTGTAGCT
[A,G]
AGATTGTACTCCCTAACGCTGGTCAGCTTACTTGGAGTTGTCTCAAGTCCCTGTGTTTAT
CTTAAGAAAGAAATTAATGTAGTTCAACAGCCCCTCTACTAGCTTTGAACACTGCAGAAA
TCTTATAGAACATTAGCGTTTATGTGGGTGGGGCCCTATTACTGAGACATCTTATAATTC
ATAAAACATCATGGTTCTCAAGATGCAAATTCTTCTATTTTTAAGTAAAATAATCAGGTT
TTGCAGACATTCAGACTAAAAATCCCAGTAGAAATTACATTAACCTAGGCAACTTTTTAA

697865 AGTAAATGTTAATTTAACATGTGAAAAAGACAATGAAGATGAAACACGTTTTAAAACAAT
ATGCAGAATAACTAAGGATTAAGCAAGGTATAAACTGGAAGATTAAAAAGGGCTTGGAGG
TGCCCTAAGAAAGGGATTCTTCTTTAGTGAAAATATCGTAGGCCCAGTCACAGACCCTGT
CCCATACTGCAGTAAGGACCTCTCACCTGCAGCGTTCAGACTGAAGGCGACAAAACAAGC
CACCCTCTGAGAGAATGCATCCCAGTTCATCTCCCAGCTCAATTCATCTCTGACAATCCA
[G,A]
AATAAATATTCTCCGCTCCTCCTTCAGCTAATTTCCCTTAGAGAAGAATTTTGTGGGAGA
CTTGAACTATTTCTTTAATCACAAAATAAAATAATCTTTAGGGAATATTTAAAGATGCCT
ATTTTTATGGCATACCCCTAGCATCTACTGTTAACAAGTGGAACAAATATTTACTTGAAC
TAAATATCCACCAACAAAAAAACAGATAAATAAAGTACGCTGTATCCAAGTGACGAGCTA
TGTAGCAGGCACTGGCAGTATGCTGCCTGGGGCTTTTCATATCTCTTTACCATTTCTGTG

700749 AGCCCTCAGAAATAATACCACACATCTACAACTATCTGATCTTTGACAAACCTGACAAAA
ACAAGAAATGGGGAAAGGATTCCCTATTTAACAAATGGTGCTGGGAAAACTGGCTAGCCA
TACGTAGAAAGCTGAAACTGGATCCCTTCCTTGCACCTTATACAAAAAAGTAATTCAAGA
TGGATTAAAGACTTAAATGTTAGACCTAAAACCATAAAAACCCTAGAAGAAAACCTAGGC
AATACCATTCAGGACATAGGCCTGGGCAAGGACTTCATGTCAAAATAGTTTATATTTTTT
[A,T]
AAATAAATATTTAGAAAGATTGATAAGGCAACAACAACATGCTTGTCACTAAAAGTTCAG
ACATGTTATCAGCATATTAAAAATGTTAAAAAAAAGATCCAGCCTGGTCACAATTCTTCT
TTATAGAAGGGTCATGTATCCAAATTTAGAGCCAAAAGAAGAGAAGCCCTTAAAACACAA
TTCCATAACTACCAATTATTCCACTTCTCCCACGGACCTCACTTTTCCTGGTTTTTATCT
AACTCATCAATACACACATCTTCCACATGTCTTTCTTCACCTGTCTTCCCAGCCTGGGTC

700948 TTAGACCTAAAACCATAAAAACCCTAGAAGAAAACCTAGGCAATACCATTCAGGACATAG
GCCTGGGCAAGGACTTCATGTCAAAATAGTTTATATTTTTTAAAATAAATATTTAGAAAG
ATTGATAAGGCAACAACAACATGCTTGTCACTAAAAGTTCAGACATGTTATCAGCATATT
AAAAATGTTAAAAAAAAGATCCAGCCTGGTCACAATTCTTCTTTATAGAAGGGTCATGTA
TCCAAATTTAGAGCCAAAAGAAGAGAAGCCCTTAAAACACAATTCCATAACTACCAATTA
[T,C]
TCCACTTCTCCCACGGACCTCACTTTTCCTGGTTTTTATCTAACTCATCAATACACACAT
CTTCCACATGTCTTTCTTCACCTGTCTTCCCAGCCTGGGTCACATGGTCCACCATTTAAA
GAATACACATTGGCCAGGCGCGGTGGGTCACGCCTGTAATCCCGGCACTTTGGGAGGCCA
AGGCGGGCAGATCACGAGATCAGGGGTTCGACACCAATCTGGCCAACATAGTGAAACCCC
ATCTCTAAGAAAAACACAAAAAATTAGCCAGGTGTGAGAGTGTGTGCCTGTAATCCCAGC

FIGURE 3IIIIIIIIII

703258 TGTAAATAAGAAAAAGTATACTTTGTAGAGAACAACATGGGCAAACTCTTAAATAACCTG
GAAACCATGGCCCATTGGAAAGTGCAGCAGACCAGTGCCTGACAGATCAAAATTCTATCC
CCATTTCTCATATTTGCTCTTTTTCATGGAGCAAATTAGACTAGTGAGTTACCCAGCAGA
AGCATCCTGCCTTTGGATGCTACTTTGGAAGCTATTTCTGTTCAAGTCTGTGTTGACTCG
CTCGTAACTTCTTGGAACTAAAAGAGCAAGACAGTAAATACCCTTGCCTTACAGAGAGAG
[T,A,G,C]
GCTAAATAAACTATAAATTCCTTTGTTAATTTTTCTCACAAGAGAAAGATCACCAAGAGA
ATGGTCACCAAATTTCTCCCTCAATTTGTGTTATTTTATATTTTTTTGCATTTGCTTTTG
GAATTGGTCTATGACAACTCACAAAACGTCTTTGTGGTAGGTAACTATAGCCATCAAAAT
GCTTGAGATGGCTGAGAGTTACCAACTGCCCTCATAATCTTGCTTCAAAGTATAATGAGA
GCAAATCAGACCTATTCTGCCTCATATGTCAACATGTATTAAATGAATATTAACAAACAA

704216 TGATTAAGTATCCACTAATTGGCTGGGCCTTATGGCTAACACCTGTAATCCCAGCACTTT
GGGAGGCCGAGGTGGGCAGATCACTTGAGGTCAGGAGTTTGAGACCAGCCTGGGCAACAT
GGCAAAAACCTGTCTCTACTAAAAATACAAAAATTAGCTGGGCATGGTGGAGAGTGCCTG
TAGTCCCAGCTCTCGGGAGGCTGAGGCAGGAGAGTCGCTTGAACCTGGGAGGTAAAGGTT
GCAGTGAGCCAGATGGTGCCACTGCACTCCAGCCTGTGTGACAGAGTGAGACTCTGTCTC
[-,A]
AAAAAAAAAAAAAAAAAAAAAAAAAAAAAAAAAATCCACTAAGTCAGCCAATGAAAATCCT
TTTCTAACATTCTGACATTCATTATGCTAATTATTAAAGCTTCTGGTATTGATCCAGTAT
AAATAGCCAACTCAGTTGTATCAGTCCCTTCTAAGGTCTGGGCTTCCTTTTAGAATGTTA
GTGAGTCATCCCTGAGTTGCGAGATCCCAAAGGTACACTAACTGTAGGCTCTGAAGTAAC
TTTCAGTAAATTACAGGCATCATAGCATTGTAGCAAGTCTCTAAAATACTAAGATCTTTC

704644 CAACTCAGTTGTATCAGTCCCTTCTAAGGTCTGGGCTTCCTTTTAGAATGTTAGTGAGTC
ATCCCTGAGTTGCGAGATCCCAAAGGTACACTAACTGTAGGCTCTGAAGTAACTTTCAGT
AAATTACAGGCATCATAGCATTGTAGCAAGTCTCTAAAATACTAAGATCTTTCATATGTG
TCCATTATTCTATTGTTGACCTCCTCTTTTACTTTCTGTTTTGTTTTTTTTTTCTAATAT
ATATACCCATGTTATCCTTTATGTTACCTTGCATTCTCGTTTGGCTTCTCTTTTTTCATT
[A,G]
TGTAGATCAGTGTATCAGTAATTATCTTGCATCTCCCAGGAAATAAGCTTTTTTGTCATG
ATCTAGAATCATATTTTCTCCAAGAGTAGTCTCTAGACCACCTGTTTAGAAAAAATCCAG
GGTACATTTTTAAAAATGCAGACCATGGCCAGGCACAGTGGCACTCACCTAGAGTCCTAG
CTTAGGCTGAGAGAGGAGGATTGCTTGAGCTCAGGAGTTCAGGTCCAGCCTGGGCAACAT
AGTGATATCCCATCTTAAAAAAAAAAAAAAAAGAAGAAGTAGACTTCTGAGGTTGATCTA

709159 AAGATGAGGCTATTAACTCTACTCTGAGTCATATGTAAGAGCAGATTTACTGTAATTTGA
GGACAGCGAACAAGCTTTCCCCAAAAGAAGCCCTCTCTATCAGGGTAAACTTTATTCCAA
AGACCACTATAAACTGGGCCATTGACCAAGTCCATCTTTGTCAGAACCTATTTGTCCAGG
ACTCAATGCGCTTCTGAGGGCATTGAGGAATGGAGGACTCATGCCCCAGTATAGCAGGCC
AAGGCCTTCTTAGCCAGCTTTAGCCTGTGATGTATCTGAATGTCTAACAAAAACTGCCTC
[G,T]
TGCTTTCGCAATAATTTTTTAGTTGTAGCTACTATTAGCAGGACTATATTTTATCCTTGA
TTTGGATGACATAACTTCTGTAGTAGTATGGCATTAAAGATTTTCTGGAAAACTCTTTTA
AAAAGATTCCAGAGGAAAAAGATGCATTTTGTAAGATAGAGCTGTACTTAAAATGATGTA
TGTGCAGAACGACAGAAAGAAACCTAAAAGCTAAGCACAACACTATACCAAGAAAAATAA
AAACTGAAATGATTAGGTAGTGATTCATTGCCCCAGAAATAATATCTATGTGAATGGTTA

709861 GGATTTTAATAAGGCTACATTGGTTACACCTGCTCATTTTCTAATGCTTCATAAAACACT
CAGGCAAGAACAGTTGCAAAGTACTTATTTTCAGCAATTCAGTTTTATCCACGTGAACAT
ATATTCTTTAAAGAATATTTGGGTACTTCTTGCCATACAAAATAATTTTCCTATTTAGGA
AATAGGACAATTTACCTAATTGTTTTATTAATTAATTATACCTATAGTCTGCCTTTTCAG
ACTAAAGGAGATGAAAACAAATATTCTCTAGACAGTACTAGCTTCTGCTGGTTTCTGCCA
[T,G,C,A]
TGTTGTAGCCCTGTGACTTAGAGGAATCAGGACAATTCAATTACTGAGTTTGAATCAAGT
CTTTGAAAGTACAGTACAGTGGCTTCTGCTTATTGCAACCACTTTAGGAAACGGTTATTT
GAGCCTAATAGCTGACTGATTCAATTAAAGGAGACAGGAAAACCATTTGCTAAGGCAAGC
ATTGTGCTTGTTATTCACTGCTATCATCTAAAGCGCATCTCTGAAATCACAACTTTGTAA
GCCAATGGCTCTACATCTTTCCCCTTCTCTGTCTATTTGGAGGCTGTGGCACAAATAGCC

712946 GAAAATTGACAGGATCAATGGATTCCTGGATTTGGTGGAGCTAAAGGATTATTGGAGACA
TCCTACTAGAATAAGAGATAAAGACAAAATGTGAGGCCAGGCATGGTGGCTCAAGCCTGC
AATCCTAGCATTTTGGGAGGCCAAGGTGGGCGGATCACCTGAGTTCAGGAGTTCAAGACC
AGACTAGCCAACATGGCGAAACCTTGTCTCTACTAAAAATACAAAAATTAGCCAGGCATG
GTGGCAGGCGCCTGTAATCCCAGCTATTTGGGTGGTTGAGGCAGGAGGATTGCATGAATC
[T,C,A,G]
GGGAGGTGGAGGTTGCAGTGAGCCAAGACTGCGCCATTGCACTCCAGCCTGGACAACAAG
AACGAAACTCCATCTTAAAAAAAAAAAAAAAAAAAAAAAAAGATGTGGTTGTTGAAGAGTA

FIGURE 3JJJJJJJJJJ

GGCTTCTTGAAATTGAGGTTATGGAGGCAAAGCAGTTTGGTAATGACAAGGTCCAGAGTA
TAACCATGGAAGTGAATGACTAATATAAGGCAGAAAAGAAGAGGAGTTAAAAGAACTGTA
ATTAAACAGGAATGTTATTACACAGATTATAATGTCAATATGAATTAAGGGGACATTAAT

719028 CCTTATACATTAGTACAGATGTAGTAACTATAAAAAGGATAATCAAATCACCCTCTGAGG
TATTCAATTGCTTTTCATATTTGGAATAGAATTAAAGTAACGAAAAATGAAACCTTACAA
TTTTACAGAGAGGAGAGTGGCTGGCAAAAATAAGCTTGTCATGGTTTAATTTGAAGTTTT
CTAGCTTACTAAAAATTTTCTTTTTGAATTTTAAATTCCCTGAAGCATGGCAAGTCTTGG
GGCAGGGTGGCTTGAGGGTTGATAAATTCGGCTGCTCACCAACCCCACACAAGGCCCACG
[A,C,T]
ACTTCTTTCTATATTTCTCCTTTGCCCTTCTGTATTCGGTTTAGCTCTCTTTCTGGCTGC
AAGATGACCGTTGCATTTCTAGTCATCTCACCCAGACTTAACATTTCCAGAGGAAGAAAA
GGAATTGTTCATTAAGCTGTCCCAGAAGCACCCCAGCTGACTTCTCATGCTGCATTAGCT
GAAGCCCATTCCTAAATCAATCATAGGCAAAGAGAATGGGATTACCACAAAGGATTTTGT
GAATATGGCTGTATGGAATAGGGTGATTACTCAACACACTTAGGTGCTGCTTGAAAAGAA

721071 TATTTCTTGCTCATTCTTCAGATCTTGTAGCTAGAAATTGTGCTGTACATGGACATAATG
TAGAGACTTAGTATGACAGAGGCCTCCACCATCTGAAATATCTCCAGTCACTGTAACAGG
AGGAAAGTGAATGACAAATAGCACACTGACTCTTAAAAACTTTGACTGGAAGTGACACCC
ATCATTTTCACCTATATTTTGTCGACCAACACAAGTCACATGGCCATGCCTAACTTCAAA
GTAGTGGACAAAAACAATCCCTCCATTTACTCAGAAAGAGAAGAACATATATTTGTAAAC
[A,G]
GCGAACGATGATTACTACAGGTACTTTTAACACATGGTAATATATAGGAGAACTGAACCA
TGGAGAAAACCAAGTAACTAGCCAAAGATTACACAATAATCAAATGCAAATCTAAGATTC
ATATCTAGGATCAAGTCCACATCTTACTATTATTCTACCTCCTTTGATGTAAATTTTTTG
GTAAATCTCTGAGCCCTGGAATGGCAAATGGCATTACACTAAGCATTATATTCTTGGTGA
GAAATTATGATGAGTAACTCAAGCAAGATCTGTACATCTTCTAGTTTAGTGAACAATATA

724053 AAGCCATCATTCTAAGCAAACTATCGCAGAAAACCAAACACCGCATGTTCTCACTCATAG
GTGGGAACTGAACAATGAGAACACATGGACACAGGATGGGGAACATCACACACTGGGGCC
TGTCATGGGGTGGGGGGAGGGGGGAGGGATAGCATTAGGAGATATACCTAATGTAAATGA
TGAGTTAACAGGTGTAGCACACCAACATGGCACATGTATACATATGTAACAAACTGCACC
TTGTGCACATGTACCCTAGAACTTAAAGTATAATAAAAAAAAAAAGAACTAGAAAAAAAA
[-,T,G]
TAACGTACTTCTACCCACTTTGTTTCTAAATGGGATTACACTTTTTTAAAAACTAACTTG
TGCTTAGCCTACTTCCAAATATAGGAAAGAAATAATTATTTCATTAAAAAAGTAAAGCCC
CTTTCATTCATAAAAGAGCTATACCCCCAATCCTTTTAAATATCTTTGTATTTTTAAGTT
TTTTATTATTCATTGAGTAAACCAAATGTATAGATTATGCCTATCATTAAAATGCTCAAT
ATAGTTTTACCTTTCTTCAAAATTCTCCTCTCTATAAACTTTGACATGCCTCCTATTTGC

725192 CTGAGTGAGCCCACCTTCCTCATTGCTGCATTTTGTTTTTAACGACAATTAAGATATTAT
TTACATAACAGAAATGTCGATCATTTAAAGTGTTACCATTTGATGATTTTTTTTGTATAT
TTATAGAGTTGTGCAACTATGACTGTACTCTAATTTTAGAACATTGTCACACCCCCCCTA
AAAATCTCATACCCATTAGCAGTCATTCCCCATCCCCTTCCCGCTCTTTCCCAGCCCTAG
GCAACTACAAATCTTTCTGTGTTTTCTGATGGTGGACAAATGGGATCACCCAACACATGG
[T,A]
CTTTTGTGACTTGCTTCTTTCGCTAAGCATAATGTTTTCAAAGTTTGTCTGTATTGTAGC
ATGTATCAATACTTCATTCCTCTTTCTTGCCTAGTAATCTTCCATTGTATGAATATACCA
CATTTTGTTTATTCATTCATCAGTGATGAACATTTGGGTTGTTTCTGTTTTTTGGCTGTT
ATGGATAATTTTGCTATTGATCTTCATTTGCAAATTTTTGTGTGGACACATGTTTTTATT
TATCTTGGGTATATCCCTAGAAGTGAAATTGCTGAGTCATGGTGGAGTTAAACAGGATAA

725564 CTTCATTCCTCTTTCTTGCCTAGTAATCTTCCATTGTATGAATATACCACATTTTGTTTA
TTCATTCATCAGTGATGAACATTTGGGTTGTTTCTGTTTTTTGGCTGTTATGGATAATTT
TGCTATTGATCTTCATTTGCAAATTTTTGTGTGGACACATGTTTTTATTTATCTTGGGTA
TATCCCTAGAAGTGAAATTGCTGAGTCATGGTGGAGTTAAACAGGATAACTCTGTGTTTA
ACTTTTTGAAAAGCTGCTAAATTGTTTTCCAAAGTGGCTGCACTATTTTTATCATCCCAC
[C,T,A,G]
GGTAAGGAATGAGGGTTCTAATTTCAGGACATCCTGGCTAACACCTGTTGTTGTCTATCT
TTTTCATTATAGCCATTTCTAATGGATGTGAAATGGTATTTCATTATGATATTGACTTGC
ATTTCCCTAATTACTAATGATGTTGAACATTATATGTGCTTATTAGCCATTCATCTGTCT
TCTTTGGAACAATGTCTACTTTTCGCCCTTTTTTTTTTTTTTTGGAGACAGAGTTTCACTC
TTGTTGCCCAGGCTGGAGCGTAGTGGCACAATCGAGGCTCACTGCAACCTCCACCTCCTG

728076 GTTGCCAGAAATGTCATAAATCTCAAAAAGGCCATTCTTGTCCTGAACCAATTGACCCTT
CAGCGCCGAATCCTCAGCTACCTCAGGAGTCCTACTGGACCTCACTGCCATTTTCTGAAT
AATTTATGTGATTTACAGTGCCTTGTAAAAAGCACTGAAACATCTCTCTGTGTGACTCGT
TTGCTTTTAATTTATAGTGACATCTTTTCGTAGTAGTGGAAACTTGCTGAAAAACTTTTC

FIGURE 3KKKKKKKKKK

TGAAACATTATGTTTTTCATTCATACTCACATCACTGTGGCTCAGTTTTCAGTGACCTCA
[A,G,T,C]
TTTTCTGCTCTGTTGTTTTTCAAATTAAAAAATACATATGGGCAGTTTCTTGACAAAGTC
ACACATTAAATAACATTACCCATAGATCATTATCCTGTGTGCACTCTGCCATTACCAATG
GTTACCTGACCTTTAGAATTAAGGAGAGCATTATGAGCATCTATTGAGATATTATAAGCT
GTAATATTATTAGCATTTCTTAGGGTCAGCTGTAATGTTTACATTGCAGCTATGCTGGTG
TCTCGGAGAAGGACACGTGTGGTTGGTAAGTGGCCCTTGTCAAGTCCTCATGATGGTCTG

733399 TAGGGTGCTGCTGGCTTTCCTCCCCAAACTGCTTCCACCTAAAACTTCCCAAGTTGACTC
CCAAAATAGGTTGACTATTCACACCTGTTTTATACTCAGCGCCTGGCCCTAGTTTTATTG
GCATGTTAAGAGAAGTGAAGTAAAATATTAATGATTTTTAAAGACAAAAACAAAGCATTA
AAAGTAGATAGCCAATGCATGTTTTTTGTTTGTTTGTTTGTTTTTGAGACGGAGTTTCAC
TCTTGTTGCCCAGGCTGGAGTGCAGTGGCACAATCTTGACTCACCACAACCTCCGCCTCC
[C,T,G,A]
GGGTTCAAGCAATTCTCCTGCCTCAGCCTCCCGAGTACCTGGGATTAGAGGCATGCACCA
CCATGCCCGGCTAATTTTGTATTTTTAGTAGTGATGGGGTTTCTCCATGTTGGTCAGGCT
GGTCTGGAACTCCTGACCTCAGGTCTGCCTGCCTTGGCCTCCCAAAGTGCTGGGATTACA
GTTGTGAGCCGTCGTGACCGGCAGCCAATATATGTTTTCTTCATCTACTTACTAATAAAG
AAATAGACATTTTCTTCAGAAGAAAAAAATGCATGATAATCAAACTGCTTCACAATCTAT

733447 CCAAGTTGACTCCCAAAATAGGTTGACTATTCACACCTGTTTTATACTCAGCGCCTGGCC
CTAGTTTTATTGGCATGTTAAGAGAAGTGAAGTAAAATATTAATGATTTTTAAAGACAAA
AACAAAGCATTAAAAGTAGATAGCCAATGCATGTTTTTTGTTTGTTTGTTTGTTTTTGAG
ACGGAGTTTCACTCTTGTTGCCCAGGCTGGAGTGCAGTGGCACAATCTTGACTCACCACA
ACCTCCGCCTCCCGGGTTCAAGCAATTCTCCTGCCTCAGCCTCCCGAGTACCTGGGATTA
[G,C]
AGGCATGCACCACCATGCCCGGCTAATTTTGTATTTTTAGTAGTGATGGGGTTTCTCCAT
GTTGGTCAGGCTGGTCTGGAACTCCTGACCTCAGGTCTGCCTGCCTTGGCCTCCCAAAGT
GCTGGGATTACAGTTGTGAGCCGTCGTGACCGGCAGCCAATATATGTTTTCTTCATCTAC
TTACTAATAAAGAAATAGACATTTTCTTCAGAAGAAAAAAATGCATGATAATCAAACTGC
TTCACAATCTATTTCTTGAATTAAAGGTTTTTTTTTTTTTGTAAAACCGTATTTTGCCAAC

782935 ACAGACAAATGGAAGTTTGATCAATGAATTCACCATAAGAAGGAGAAGAACTATCACAGC
AAATGTAGAAAAGGACATGGATTCAGGGGTAGGTCAGACAGGGGAAGAATGAACATCCTG
TGGCTACTCTCCTTGTGGGGATAAGGGATGGGCTATTCCTTAAGTTTCAAAACAAAATTT
TATGCAAGAGAAAAAAGTATAAGAAGAAGGGGGATAGCAAGATGTGAGTTCTCTCAACAT
CCATCATAAAGAAATTAAAAAGAAAAAAAAGATCAATGTAAGTCCCAGTCATAGCAAAAA
[G,A]
CACAAAAAGACAAAAGTGTTCCACCAGATAAGTCACTGATTTGATAAATAATTTTTTAAA
GTGACTGATTTGAATAAGATAGAAAATCAGAGGCTTTCAAATGGAGAATAAAAACATTAG
ATGTAAGAATATTGTAAAAGTAAAAATAAAGTTCCGTGATTTGTGCTTTATTTGGCTTTT
AAATGCTCTCCATGTTTTGTTTTGTTTTGTTTTCTTACAGAATGCCAGAGTCCCCTGGTG
AAGTTCCGGAATATCCTTTGTTTGTCACAGTTGGTGACTGGCTAGATTCTATAAAGATGG

784250 GTTGCAAATGTATATCATTACCTAAATTATATAGCATTTACGCCTATGAAATATCTGAGT
ATTACATAAGTACCTGTGTATAAAATTGAAATATATATATTATTACATCTGAGATTAACT
TTATGTATTCTGTGGATCCAGAGAAAAGGAAAAAAAGAAACAAACTTTTGCTGCTCATTT
AAATCTCTGTTTAACAAGTAAGCTACACTATTTTTGGTAACTGTGGCAGAGTGCTTATTT
AATATATTTAAATATTCACTTTATCTTGCATGCTTATTAGATCTGAATGTTCATATTCTG
[T,G]
ACTCTCTCTCTCTCTCTCTCTTTCTTGCTCTCACTCTCGCTCTCACTCTTGCTCTCTCCT
TTCTTTCAGTGACATTAGAAGAATTGGAGTCATACTTATTGGACACCAGAGACGAATAGT
CAGCAGCATACAGACTTTACGTTTACACATGATGCACATACAGGAGAAGGGATTTCATGT
ATGAAAGTACCACAAGCACCTGTGTTTTGTGCCTCAGCATTTCTAAAATGAACGATATCC
TCTCTACTACTCTCTCTTCTGATTCTCCAAACATCACTTCACAAACTGCAGTCTTCTGTT

FIGURE 3LLLLLLLLLL

ISOLATED HUMAN KINASE PROTEINS, NUCLEIC ACID MOLECULES ENCODING HUMAN KINASE PROTEINS, AND USES THEREOF

FIELD OF THE INVENTION

The present invention is in the field of kinase proteins that are related to the receptor tyrosine kinase subfamily, recombinant DNA molecules, and protein production. The present invention specifically provides novel peptides and proteins that effect protein phosphorylation and nucleic acid molecules encoding such peptide and protein molecules, all of which are useful in the development of human therapeutics and diagnostic compositions and methods.

BACKGROUND OF THE INVENTION

Protein Kinases

Kinases regulate many different cell proliferation, differentiation, and signaling processes by adding phosphate groups to proteins. Uncontrolled signaling has been implicated in a variety of disease conditions including inflammation, cancer, arteriosclerosis, and psoriasis. Reversible protein phosphorylation is the main strategy for controlling activities of eukaryotic cells. It is estimated that more than 1000 of the 10,000 proteins active in a typical mammalian cell are phosphorylated. The high energy phosphate, which drives activation, is generally transferred from adenosine triphosphate molecules (ATP) to a particular protein by protein kinases and removed from that protein by protein phosphatases. Phosphorylation occurs in response to extracellular signals (hormones, neurotransmitters, growth and differentiation factors, etc), cell cycle checkpoints, and environmental or nutritional stresses and is roughly analogous to turning on a molecular switch. When the switch goes on, the appropriate protein kinase activates a metabolic enzyme, regulatory protein, receptor, cytoskeletal protein, ion channel or pump, or transcription factor.

The kinases comprise the largest known protein group, a superfamily of enzymes with widely varied functions and specificities. They are usually named after their substrate, their regulatory molecules, or some aspect of a mutant phenotype. With regard to substrates, the protein kinases may be roughly divided into two groups; those that phosphorylate tyrosine residues (protein tyrosine kinases, PTK) and those that phosphorylate serine or threonine residues (serine/threonine kinases, STK). A few protein kinases have dual specificity and phosphorylate threonine and tyrosine residues. Almost all kinases contain a similar 250–300 amino acid catalytic domain. The N-terminal domain, which contains subdomains I–IV, generally folds into a two-lobed structure, which binds and orients the ATP (or GTP) donor molecule. The larger C terminal lobe, which contains subdomains VI A-XI, binds the protein substrate and carries out the transfer of the gamma phosphate from ATP to the hydroxyl group of a serine, threonine, or tyrosine residue. Subdomain V spans the two lobes.

The kinases may be categorized into families by the different amino acid sequences (generally between 5 and 100 residues) located on either side of, or inserted into loops of, the kinase domain. These added amino acid sequences allow the regulation of each kinase as it recognizes and interacts with its target protein. The primary structure of the kinase domains is conserved and can be further subdivided into 11 subdomains. Each of the 11 subdomains contains specific residues and motifs or patterns of amino acids that are characteristic of that subdomain and are highly conserved (Hardie, G. and Hanks, S. (1995) *The Protein Kinase Facts Books, Vol. I*:7–20 Academic Press, San Diego, Calif.).

The second messenger dependent protein kinases primarily mediate the effects of second messengers such as cyclic AMP (cAMP), cyclic GMP, inositol triphosphate, phosphatidylinositol, 3,4,5-triphosphate, cyclic-ADPribose, arachidonic acid, diacylglycerol and calcium-calmodulin. The cyclic-AMP dependent protein kinases (PKA) are important members of the STK family. Cyclic-AMP is an intracellular mediator of hormone action in all prokaryotic and animal cells that have been studied. Such hormone-induced cellular responses include thyroid hormone secretion, cortisol secretion, progesterone secretion, glycogen breakdown, bone resorption, and regulation of heart rate and force of heart muscle contraction. PKA is found in all animal cells and is thought to account for the effects of cyclic-AMP in most of these cells. Altered PKA expression is implicated in a variety of disorders and diseases including cancer, thyroid disorders, diabetes, atherosclerosis, and cardiovascular disease (Isselbacher, K. J. et al. (1994) *Harrison's Principles of internal Medicine*, McGraw-Hill, New York, N.Y., pp. 416–431, 1887).

Calcium-calmodulin (CaM) dependent protein kinases are also members of STK family. Calmodulin is a calcium receptor that mediates many calcium regulated processes by binding to target proteins in response to the binding of calcium. The principle target protein in these processes is CaM dependent protein kinases. CaM-kinases are involved in regulation of smooth muscle contraction (MLC kinase), glycogen breakdown (phosphorylase kinase), and neurotransmission (CaM kinase I and CaM kinase II). CaM kinase I phosphorylates a variety of substrates including the neurotransmitter related proteins synapsin I and II, the gene transcription regulator, CREB, and the cystic fibrosis conductance regulator protein, CFTR (Haribabu, B. et al. (1995) *EMBO Journal* 14:3679–86). CaM II kinase also phosphorylates synapsin at different sites, and controls the synthesis of catecholamines in the brain through phosphorylation and activation of tyrosine hydroxylase. Many of the CaM kinases are activated by phosphorylation in addition to binding to CaM. The kinase may autophosphorylate itself, or be phosphorylated by another kinase as part of a "kinase cascade".

Another ligand-activated protein kinase is 5'-AMP-activated protein kinase (AMPK) (Gao, G. et al. (1996) *J. Biol Chem.* 15:8675–81). Mammalian AMPK is a regulator of fatty acid and sterol synthesis through phosphorylation of the enzymes acetyl-CoA carboxylase and hydroxymethylglutaryl-CoA reductase and mediates responses of these pathways to cellular stresses such as heat shock and depletion of glucose and ATP. AMPK is a heterotrimeric complex comprised of a catalytic alpha subunit and two non-catalytic beta and gamma subunits that are believed to regulate the activity of the alpha subunit. Subunits of AMPK have a much wider distribution in non-lipogenic tissues such as brain, heart, spleen, and lung than expected. This distribution suggests that its role may extend beyond regulation of lipid metabolism alone.

The mitogen-activated protein kinases (MAP) are also members of the STK family. MAP kinases also regulate intracellular signaling pathways. They mediate signal transduction from the cell surface to the nucleus via phosphorylation cascades. Several subgroups have been identified, and each manifests different substrate specificities and responds to distinct extracellular stimuli (Egan, S. E. and Weinberg, R. A. (1993) *Nature* 365:781–783). MAP kinase signaling pathways are present in mammalian cells as well as in yeast. The extracellular stimuli that activate mammalian pathways include epidermal growth factor (EGF), ultraviolet light, hyperosmolar medium, heat shock, endotoxic lipopolysaccharide (LPS), and pro-inflammatory cytokines such as tumor necrosis factor (TNF) and interleukin-1 (IL-1).

PRK (proliferation-related kinase) is a serum/cytokine inducible STK that is involved in regulation of the cell cycle and cell proliferation in human megakaroytic cells (Li, B. et al. (1996) *J. Biol. Chem.* 271:19402–8). PRK is related to the polo (derived from humans polo gene) family of STKs implicated in cell division. PRK is downregulated in lung tumor tissue and may be a proto-oncogene whose deregulated expression in normal tissue leads to oncogenic transformation. Altered MAP kinase expression is implicated in a variety of disease conditions including cancer, inflammation, immune disorders, and disorders affecting growth and development.

The cyclin-dependent protein kinases (CDKs) are another group of STKs that control the progression of cells through the cell cycle. Cyclins are small regulatory proteins that act by binding to and activating CDKs that then trigger various phases of the cell cycle by phosphorylating and activating selected proteins involved in the mitotic process. CDKs are unique in that they require multiple inputs to become activated. In addition to the binding of cyclin, CDK activation requires the phosphorylation of a specific threonine residue and the dephosphorylation of a specific tyrosine residue.

Protein tyrosine kinases, PTKs, specifically phosphorylate tyrosine residues on their target proteins and may be divided into transmembrane, receptor PTKs and nontransmembrane, non-receptor PTKs. Transmembrane protein-tyrosine kinases are receptors for most growth factors. Binding of growth factor to the receptor activates the transfer of a phosphate group from ATP to selected tyrosine side chains of the receptor and other specific proteins. Growth factors (GF) associated with receptor PTKs include; epidermal GF, platelet-derived GF, fibroblast GF, hepatocyte GF, insulin and insulin-like GFs, nerve GF, vascular endothelial GF, and macrophage colony stimulating factor.

Non-receptor PTKs lack transmembrane regions and, instead, form complexes with the intracellular regions of cell surface receptors. Such receptors that function through non-receptor PTKs include those for cytokines, hormones (growth hormone and prolactin) and antigen-specific receptors on T and B lymphocytes.

Many of these PTKs were first identified as the products of mutant oncogenes in cancer cells where their activation was no longer subject to normal cellular controls. In fact, about one third of the known oncogenes encode PTKs, and it is well known that cellular transformation (oncogenesis) is often accompanied by increased tyrosine phosphorylation activity (Carbonneau H and Tonks NK (1992) *Annu. Rev. Cell. Biol.* 8:463–93). Regulation of PTK activity may therefore be an important strategy in controlling some types of cancer.

Receptor Tyrosine Kinases

The novel human protein, and encoding gene, provided by the present invention is related to the family of receptor tyrosine kinases (RTKs), particularly the Eph or EPH (erythropoietin-producing hepatoma) subfamily of RTKs, including Ehk Eph-like RTKs. Eph and Eph-related receptors form the biggest subfamily of receptor protein-tyrosine kinases. Eph RTKs play important roles in development, particularly in development of the nervous system. In particular, Eph RTKs are important for establishing the specificity of neuron-target cell interactions (Garrity and Zipursky, 1995). The ligands of Eph receptors are called ephrins. Ephlins are thought to play key roles in protease recognition and control of cell surface proteins, and, in the case of ephrin-A2, are important for axon detachment and termination of signaling (Hattori et al., *Science* 289: 1360–1365, 2000). Therefore, novel human RTKs, particularly Eph and Eph-like RTKs, are useful for such uses as screening for, diagnosing, preventing, and/or treating neurological disorders. For example, novel Eph or Eph-like proteins/genes may serve as novel drug targets for treating neurological disorders and SNPs in Eph or Eph-like genes may be useful diagnostic markers in kits for diagnosing neurological disorders.

For a further review of RTKs, including Eph and Eph-like RTKs, see Lee et al., *DNA Cell Biol* 1996 October; 15(10) :817–25; Fox et al., *Oncogene* 10: 897–905, 1995; Maisonpierre et al., *Oncogene* 8: 3277–3288, 1993; Zhou et al., *.J. Neurosci. Res.* 37: 129–143, 1994; Maru et al., *Molec. Cell. Biol.* 8: 3770–3776, 1988; and Yoshida et al., *Cytogenet. Cell Genet.* 51: 1113, 1989

Kinase proteins, particularly members of the receptor tyrosine kinase subfamily, are a major target for drug action and development. Accordingly, it is valuable to the field of pharmaceutical development to identify and characterize previously unknown members of this subfamily of kinase proteins. The present invention advances the state of the art by providing previously unidentified human kinase proteins that have homology to members of the receptor tyrosine kinase subfamily.

SUMMARY OF THE INVENTION

The present invention is based in part on the identification of amino acid sequences of human kinase peptides and proteins that are related to the receptor tyrosine kinase subfamily, as well as allelic variants and other mammalian orthologs thereof. These unique peptide sequences, and nucleic acid sequences that encode these peptides, can be used as models for the development of human therapeutic targets, aid in the identification of therapeutic proteins, and serve as targets for the development of human therapeutic agents that modulate kinase activity in cells and tissues that express the kinase. Experimental data as provided in FIG. 1 indicates expression in humans in testis, nervous tissue, kidney tumors, fetal brain, and a pooled fetal lung/testis/B-cell sample.

DESCRIPTION OF THE FIGURE SHEETS

FIG. 1 provides the nucleotide sequence of a cDNA molecule that encodes the kinase protein of the present invention. (SEQ ID NO:1) In addition, structure and functional information is provided, such as ATG start, stop and tissue distribution, where available, that allows one to readily determine specific uses of inventions based on this molecular sequence. Experimental data as provided in FIG. 1 indicates expression in humans in testis, nervous tissue, kidney tumors, fetal brain, and a pooled fetal lung/testis/B-cell sample.

FIG. 2 provides the predicted amino acid sequence of the kinase of the present invention. (SEQ ID NO:2) In addition structure and functional information such as protein family, function, and modification sites is provided where available, allowing one to readily determine specific uses of inventions based on this molecular sequence.

FIG. 3 provides genomic sequences that span the gene encoding the kinase protein of the present invention. (SEQ ID NO:3) In addition structure and functional information, such as intron/exon structure, promoter location, etc., is provided where available, allowing one to readily determine specific uses of inventions based on this molecular sequence. As illustrated in FIG. 3, SNPs were identified at 208 different nucleotide positions.

DETAILED DESCRIPTION OF THE INVENTION

General Description

The present invention is based on the sequencing of the human genome. During the sequencing and assembly of the human genome, analysis of the sequence information revealed previously unidentified fragments of the human genome that encode peptides that share structural and/or sequence homology to protein/peptide/domains identified and characterized within the art as being a kinase protein or part of a kinase protein and are related to the receptor tyrosine kinase subfamily. Utilizing these sequences, additional genomic sequences were assembled and transcript and/or cDNA sequences were isolated and characterized. Based on this analysis, the present invention provides amino acid sequences of human kinase peptides and proteins that are related to the receptor tyrosine kinase subfamily, nucleic acid sequences in the form of transcript sequences, cDNA sequences and/or genomic sequences that encode these kinase peptides and proteins, nucleic acid variation (allelic information), tissue distribution of expression, and information about the closest art known protein/peptide/domain that has structural or sequence homology to the kinase of the present invention.

In addition to being previously unknown, the peptides that are provided in the present invention are selected based on their ability to be used for the development of commercially important products and services. Specifically, the present peptides are selected based on homology and/or structural relatedness to known kinase proteins of the receptor tyrosine kinase subfamily and the expression pattern observed. Experimental data as provided in FIG. 1 indicates expression in humans in testis, nervous tissue, kidney tumors, fetal brain, and a pooled fetal lung/testis/B-cell sample. The art has clearly established the commercial importance of members of this family of proteins and proteins that have expression patterns similar to that of the present gene. Some of the more specific features of the peptides of the present invention, and the uses thereof, are described herein, particularly in the Background of the Invention and in the annotation provided in the Figures, and/or are known within the art for each of the known receptor tyrosine kinase family or subfamily of kinase proteins.

Specific Embodiments

Peptide Molecules

The present invention provides nucleic acid sequences that encode protein molecules that have been identified as being members of the kinase family of proteins and are related to the receptor tyrosine kinase subfamily (protein sequences are provided in FIG. 2, transcript/cDNA sequences are provided in FIG. 1 and genomic sequences are provided in FIG. 3). The peptide sequences provided in FIG. 2, as well as the obvious variants described herein, particularly allelic variants as identified herein and using the information in FIG. 3, will be referred herein as the kinase peptides of the present invention, kinase peptides, or peptides/proteins of the present invention.

The present invention provides isolated peptide and protein molecules that consist of, consist essentially of, or comprise the amino acid sequences of the kinase peptides disclosed in the FIG. 2, (encoded by the nucleic acid molecule shown in FIG. 1, transcript/cDNA or FIG. 3, genomic sequence), as well as all obvious variants of these peptides that are within the art to make and use. Some of these variants are described in detail below.

As used herein, a peptide is said to be "isolated" or "purified" when it is substantially free of cellular material or free of chemical precursors or other chemicals. The peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule is discussed below).

In some uses, "substantially free of cellular material" includes preparations of the peptide having less than about 30% (by dry weight) other proteins (i.e., contaminating protein), less than about 20% other proteins, less than about 10% other proteins, or less than about 5% other proteins. When the peptide is recombinantly produced, it can also be substantially free of culture medium, i.e., culture medium represents less than about 20% of the volume of the protein preparation.

The language "substantially free of chemical precursors or other chemicals" includes preparations of the peptide in which it is separated from chemical precursors or other chemicals that are involved in its synthesis. In one embodiment, the language "substantially free of chemical precursors or other chemicals" includes preparations of the kinase peptide having less than about 30% (by dry weight) chemical precursors or other chemicals, less than about 20% chemical precursors or other chemicals, less than about 10% chemical precursors or other chemicals, or less than about 5% chemical precursors or other chemicals.

The isolated kinase peptide can be purified from cells that naturally express it, purified from cells that have been altered to express it (recombinant), or synthesized using known protein synthesis methods. Experimental data as provided in FIG. 1 indicates expression in humans in testis, nervous tissue, kidney tumors, fetal brain, and a pooled fetal lung/testis/B-cell sample. For example, a nucleic acid molecule encoding the kinase peptide is cloned into an expression vector, the expression vector introduced into a host cell and the protein expressed in the host cell. The protein can then be isolated from the cells by an appropriate purification scheme using standard protein purification techniques. Many of these techniques are described in detail below.

Accordingly, the present invention provides proteins that consist of the amino acid sequences provided in FIG. 2 (SEQ ID NO:2), for example, proteins encoded by the trnnscript/cDNA nucleic acid sequences shown in FIG. 1 (SEQ ID NO:1) and the genomic sequences provided in FIG. 3 (SEQ ID NO:3). The amino acid sequence of such a protein is provided in FIG. 2. A protein consists of an amino acid sequence when the amino acid sequence is the final amino acid sequence of the protein.

The present invention further provides proteins that consist essentially of the amino acid sequences provided in FIG. 2 (SEQ ID NO:2), for example, proteins encoded by the transcript, cDNA nucleic acid sequences shown in FIG. 1

(SEQ ID NO: 1) and the genomic sequences provided in FIG. 3 (SEQ ID NO:3). A protein consists essentially of an amino acid sequence when such an amino acid sequence is present with only a few additional amino acid residues, for example from about 1 to about 100 or so additional residues, typically from 1 to about 20 additional residues in the final protein.

The present invention further provides proteins that comprise the amino acid sequences provided in FIG. 2 (SEQ ID NO:2), for example, proteins encoded by the transcript/cDNA nucleic acid sequences shown in FIG. 1 (SEQ ID NO:1) and the genomic sequences provided in FIG. 3 (SEQ ID NO:3). A protein comprises an amino acid sequence when the amino acid sequence is at least part of the final amino acid sequence of the protein. In such a fashion, the protein can be only the peptide or have additional amino acid molecules, such as amino acid residues (contiguous encoded sequence) that are naturally associated with it or heterologous amino acid residues/peptide sequences. Such a protein can have a few additional amino acid residues or can comprise several hundred or more additional amino acids. The preferred classes of proteins that are comprised of the kinase peptides of the present invention are the naturally occurring mature proteins. A brief description of how various types of these proteins can be made/isolated is provided below.

The kinase peptides of the present invention can be attached to heterologous sequences to form chimeric or fusion proteins. Such chimeric and fusion proteins comprise a kinase peptide operatively linked to a heterologous protein having an amino acid sequence not substantially homologous to the kinase peptide. “Operatively linked” indicates that the kinase peptide and the heterologous protein are fused in-frame. The heterologous protein can be fused to the N-terminus or C-terminus of the kinase peptide.

In some uses, the fusion protein does not affect the activity of the kinase peptide per se. For example, the fusion protein can include, but is not limited to, enzymatic fusion proteins, for example beta-galactosidase fusions, yeast two-hybrid GAL fusions, poly-His fusions, MYC-tagged, HI-tagged and Ig fusions. Such fusion proteins, particularly poly-His fusions, can facilitate the purification of recombinant kinase peptide. In certain host cells (e.g., mammalian host cells), expression and/or secretion of a protein can be increased by using a heterologous signal sequence.

A chimeric or fusion protein can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragrents which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A kinase peptide-encoding nucleic acid can be cloned into such an expression vector such that the fusion moiety is linked in-frame to the kinase peptide.

As mentioned above, the present invention also provides and enables obvious variants of the amino acid sequence of the proteins of the present invention, such as naturally occurring mature forms of the peptide, allelic/sequence variants of the peptides, non-naturally occurring recombinantly derived variants of the peptides, and orthologs and paralogs of the peptides. Such variants can readily be generated using art-known techniques in the fields of recombinant nucleic acid technology and protein biochemistry. It is understood, however, that variants exclude any amino acid sequences disclosed prior to the invention.

Such variants can readily be identified/made using molecular techniques and the sequence information disclosed herein. Further, such variants can readily be distinguished from other peptides based on sequence and/or structural homology to the kinase peptides of the present invention. The degree of homology/identity present will be based primarily on whether the peptide is a functional variant or non-functional variant, the amount of divergence present in the paralog family and the evolutionary distance between the orthologs.

To determine the percent identity of two amino acid sequences or two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid “identity” is equivalent to amino acid or nucleic acid “homology”). The percent identity between the two sequences is a function of the number of identical positions shared by the sequences, taking into account the number of gaps, and the length of each gap, which need to be introduced for optimal alignment of the two sequences.

The comparison of sequences and determination of percent identity and similarity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch (*J. Mol. Biol.* (48):444–453 (1970)) algorithm which has been incorporated into the GAP program in the GCG software package (available at http://www.gcg.com), using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (Devereux, J., et al., *Nucleic Acids Res.* 12(1):387 (1984)) (available at http:/Hwww.gcg.com), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11–17 (1989)) which has been incorporated into the ALIGN program (version 2.0), using a PAM120 weight residue table, a gap length penalty of 12 and a gap penalty of 4.

The nucleic acid and protein sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215:403–10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389–3402 (1997)). When utilizing BLAST and gapped BLAST programs, the default parameters of the respective programs (e.g., XBLAST and NBLAST) can be used.

Full-length pre-processed forms, as well as mature processed forms, of proteins that comprise one of the peptides of the present invention can readily be identified as having complete sequence identity to one of the kinase peptides of the present invention as well as being encoded by the same genetic locus as the kinase peptide provided herein. The gene encoding the novel kinase protein of the present invention is located on a genome component that has been mapped to human chromosome 3 (as indicated in FIG. 3), which is supported by multiple lines of evidence, such as STS and BAC map data.

Allelic variants of a kinase peptide can readily be identified as being a human protein having a high degree (significant) of sequence homology/identity to at least a portion of the kinase peptide as well as being encoded by the same genetic locus as the kinase peptide provided herein. Genetic locus can readily be determined based on the genomic information provided in FIG. 3, such as the genomic sequence mapped to the reference human. The gene encoding the novel kinase protein of the present invention is located on a genome component that has been mapped to human chromosome 3 (as indicated in FIG. 3), which is supported by multiple lines of evidence, such as STS and BAC map data. As used herein, two proteins (or a region of the proteins) have significant homology when the amino acid sequences are typically at least about 70–80%, 80–90%, and more typically at least about 90–95% or more homologous. A significantly homologous amino acid sequence, according to the present invention, will be encoded by a nucleic acid sequence that will hybridize to a kinase peptide encoding nucleic acid molecule under stringent conditions as more fully described below.

FIG. 3 provides information on SNPs that have been found in the gene encoding the kinase protein of the present invention. SNPs were identified at 208 different nucleotide positions. These SNPs are all located in introns and may affect control/regulatory elements.

Paralogs of a kinase peptide can readily be identified as having some degree of significant sequence homology/identity to at least a portion of the kinase peptide, as being encoded by a gene from humans, and as having similar activity or function. Two proteins will typically be considered paralogs when the amino acid sequences are typically at least about 60% or greater, and more typically at least about 70% or greater homology through a given region or domain. Such paralogs will be encoded by a nucleic acid sequence that will hybridize to a kinase peptide encoding nucleic acid molecule under moderate to stringent conditions as more fully described below.

Orthologs of a kinase peptide can readily be identified as having some degree of significant sequence homology/identity to at least a portion of the kinase peptide as well as being encoded by a gene from another organism. Preferred orthologs will be isolated from mammals, preferably primates, for the development of human therapeutic targets and agents. Such orthologs will be encoded by a nucleic acid sequence that will hybridize to a kinase peptide encoding nucleic acid molecule under moderate to stringent conditions, as more fully described below, depending on the degree of relatedness of the two organisms yielding the proteins.

Non-naturally occurring variants of the kinase peptides of the present invention can readily be generated using recombinant techniques. Such variants include, but are not limited to deletions, additions and substitutions in the amino acid sequence of the kinase peptide. For example, one class of substitutions are conserved amino acid substitution.

Such substitutions are those that substitute a given amino acid in a kinase peptide by another amino acid of like characteristics. Typically seen as conservative substitutions are the replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., *Science* 247:1306–1310 (1990).

Variant kinase peptides can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions. FIG. 2 provides the result of protein analysis and can be used to identify critical domains/regions. Functional variants can also contain substitution of similar amino acids that result in no change or an insignificant change in function. Alternatively, such substitutions may positively or negatively affect function to some degree.

Non-functional variants typically contain one or more non-conservative amino acid substitutions, deletions, insertions, inversions, or truncation or a substitution, insertion, inversion, or deletion in a critical residue or critical region.

Amino acids that are essential for function can be identified by methods known in the art, such as site-directed mutagenesis or alanine-scanning mutagenesis (Cunningham et al., *Science* 244:1081–1085 (1989)), particularly using the results provided in FIG. 2. The latter procedure introduces single alanine mutations at every residue in the molecule. The resulting mutant molecules are then tested for biological activity such as kinase activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899–904 (1992); de Vos et al. *Science* 255:306–312 (1992)).

The present invention further provides fragments of the kinase peptides, in addition to proteins and peptides that comprise and consist of such fragments, particularly those comprising the residues identified in FIG. 2. The fragments to which the invention pertains, however, are not to be construed as encompassing fragments that may be disclosed publicly prior to the present invention.

As used herein, a fragment comprises at least 8, 10, 12, 14, 16, or more contiguous amino acid residues from a kinase peptide. Such fragments can be chosen based on the ability to retain one or more of the biological activities of the kinase peptide or could be chosen for the ability to perform a function, e.g. bind a substrate or act as an immunogen. Particularly important fragments are biologically active fragments, peptides that are, for example, about 8 or more amino acids in length. Such fragments will typically comprise a domain or motif of the kinase peptide, e.g., active site, a transmembrane domain or a substrate-binding domain. Further, possible fragments include, but are not limited to, domain or motif containing fragments, soluble peptide fragments, and fragments containing immunogenic structures. Predicted domains and functional sites are readily identifiable by computer programs well known and readily available to those of skill in the art (e.g., PROSITE analysis). The results of one such analysis are provided in FIG. 2.

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in kinase peptides are described in basic texts, detailed monographs, and the research literature, and they are well known to those of skill in the art (some of these features are identified in FIG. 2).

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993). Many detailed reviews are available on this subject, such as by Wold, F., *Posttranslational Covalent Modification of Proteins*, B. C. Johnson, Ed., Academic Press, New York 1–12 (1983); Seifter et al. (*Meth. Enzymol.* 182: 626–646 (1990)) and Rattan et al. (*Ann. N. Y. Acad. Sci.* 663:48–62 (1992)).

Accordingly, the kinase peptides of the present invention also encompass derivatives or analogs in which a substituted amino acid residue is not one encoded by the genetic code, in which a substituent group is included, in which the mature kinase peptide is fused with another compound, such as a compound to increase the half-life of the kinase peptide (for example, polyethylene glycol), or in which the additional amino acids are fused to the mature kinase peptide, such as a leader or secretory sequence or a sequence for purification of the mature kinase peptide or a pro-protein sequence.

Protein/Peptide Uses

The proteins of the present invention can be used in substantial and specific assays related to the functional information provided in the Figures; to raise antibodies or to elicit another immune response; as a reagent (including the labeled reagent) in assays designed to quantitatively determine levels of the protein (or its binding partner or ligand) in biological fluids; and as markers for tissues in which the corresponding protein is preferentially expressed (either constitutively or at a particular stage of tissue differentiation or development or in a disease state). Where the protein binds or potentially binds to another protein or ligand (such as, for example, in a kinase-effector protein interaction or kinase-ligand interaction), the protein can be used to identify the binding partner/ligand so as to develop a system to identify inhibitors of the binding interaction. Any or all of these uses are capable of being developed into reagent grade or kit format for commercialization as commercial products.

Methods for performing the uses listed above are well known to those skilled in the art. References disclosing such methods include "Molecular Cloning: A Laboratory Manual", 2d ed., Cold Spring Harbor Laboratory Press, Sambrook, J., E. F. Fritsch and T. Maniatis eds., 1989, and "Methods in Enzymology: Guide to Molecular Cloning Techniques", Academic Press, Berger, S. L. and A. R. Kimmel eds., 1987.

The potential uses of the peptides of the present invention are based primarily on the source of the protein as well as the class/action of the protein. For example, kinases isolated from humans and their human/mammalian orthologs serve as targets for identifying agents for use in mammalian therapeutic applications, e.g. a human drug, particularly in modulating a biological or pathological response in a cell or tissue that expresses the kinase. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain. A large percentage of pharmaceutical agents are being developed that modulate the activity of kinase proteins, particularly members of the receptor tyrosine kinase subfamily (see Background of the Invention). The structural and functional information provided in the Background and Figures provide specific and substantial uses for the molecules of the present invention, particularly in combination with the expression information provided in FIG. 1. Experimental data as provided in FIG. 1 indicates expression in humans in testis, nervous tissue, kidney tumors, fetal brain, and a pooled fetal lung/testis/B-cell sample. Such uses can readily be determined using the information provided herein, that which is known in the art, and routine experimentation.

The proteins of the present invention (including variants and fragments that may have been disclosed prior to the present invention) are useful for biological assays related to kinases that are related to members of the receptor tyrosine kinase subfamily. Such assays involve any of the known kinase functions or activities or properties useful for diagnosis and treatment of kinase-related conditions that are specific for the subfamily of kinases that the one of the present invention belongs to, particularly in cells and tissues that express the kinase. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain.

The proteins of the present invention are also useful in drug screening assays, in cell-based or cell-free systems. Cell-based systems can be native, i.e., cells that normally express the kinase, as a biopsy or expanded in cell culture. Experimental data as provided in FIG. 1 indicates expression in humans in testis, nervous tissue, kidney tumors, fetal brain, and a pooled fetal lung/testis/B-cell sample. In an alternate embodiment, cell-based assays involve recombinant host cells expressing the kinase protein.

The polypeptides can be used to identify compounds that modulate kinase activity of the protein in its natural state or an altered form that causes a specific disease or pathology associated with the kinase. Both the kinases of the present invention and appropriate variants and fragments can be used in high-throughput screens to assay candidate compounds for the ability to bind to the kinase. These compounds can be further screened against a functional kinase to determine the effect of the compound on the kinase activity. Further, these compounds can be tested in animal or invertebrate systems to determine activity/effectiveness. Compounds can be identified that activate (agonist) or inactivate (antagonist) the kinase to a desired degree.

Further, the proteins of the present invention can be used to screen a compound for the ability to stimulate or inhibit interaction between the kinase protein and a molecule that normally interacts with the kinase protein, e.g. a substrate or a component of the signal pathway that the kinase protein normally interacts (for example, another kinase). Such assays typically include the steps of combining the kinase protein with a candidate compound under conditions that allow the kinase protein, or fragment, to interact with the target molecule, and to detect the formation of a complex between the protein and the target or to detect the biochemical consequence of the interaction with the kinase protein and the target, such as any of the associated effects of signal transduction such as protein phosphorylation, cAMP turnover, and adenylate cyclase activation, etc.

Candidate compounds include, for example, 1) peptides such as soluble peptides, including Ig-tailed fusion peptides and members of random peptide libraries (see, e.g., Lam et al., *Nature* 354:82–84 (1991); Houghten et al., *Nature* 354:84–86 (1991)) and combinatorial chemistry-derived molecular libraries made of D- and/or L-configuration amnino acids; 2) phosphopeptides (e.g., members of random and partially degenerate, directed phosphopeptide libraries, see, e.g., Songyang et al., *Cell* 72:767–778 (1993)); 3) antibodies (e.g., polyclonal, monoclonal, humanized, anti-idiotypic, chimeric, and single chain antibodies as well as Fab, $F(ab')_2$, Fab expression library fragments, and epitope-binding fragments of antibodies); and 4) small organic and inorganic molecules (e.g., molecules obtained from combinatorial and natural product libraries).

One candidate compound is a soluble fragment of the receptor that competes for substrate binding. Other candidate compounds include mutant kinases or appropriate fragments containing mutations that affect kinase function and thus compete for substrate. Accordingly, a fragment that competes for substrate, for example with a higher affinity, or a fragment that binds substrate but does not allow release, is encompassed by the invention.

The invention further includes other end point assays to identify compounds that modulate (stimulate or inhibit) kinase activity. The assays typically involve an assay of events in the signal transduction pathway that indicate kinase activity. Thus, the phosphorylation of a substrate, activation of a protein, a change in the expression of genes that are up- or down-regulated in response to the kinase protein dependent signal cascade can be assayed.

Any of the biological or biochemical functions mediated by the kinase can be used as an endpoint assay. These include all of the biochemical or biochemical/biological events described herein, in the references cited herein, incorporated by reference for these endpoint assay targets, and other functions known to those of ordinary skill in the art or that can be readily identified using the information provided in the Figures, particularly FIG. 2. Specifically, a biological function of a cell or tissues that expresses the kinase can be assayed. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain.

Binding and/or activating compounds can also be screened by using chimeric kinase proteins in which the amino terminal extracellular domain, or parts thereof, the entire transmembrane domain or subregions, such as any of the seven transmembrane segments or any of the intracellular or extracellular loops and the carboxy terminal intracellular domain, or parts thereof, can be replaced by heterologous domains or subregions. For example, a substrate-binding region can be used that interacts with a different substrate then that which is recognized by the native kinase. Accordingly, a different set of signal transduction components is available as an end-point assay for activation. This allows for assays to be performed in other than the specific host cell from which the kinase is derived.

The proteins of the present invention are also useful in competition binding assays in methods designed to discover compounds that interact with the kinase (e.g. binding partners and/or ligands). Thus, a compound is exposed to a kinase polypeptide under conditions that allow the compound to bind or to otherwise interact with the polypeptide. Soluble kinase polypeptide is also added to the mixture. If the test compound interacts with the soluble kinase polypeptide, it decreases the amount of complex formed or activity from the kinase target. This type of assay is particularly useful in cases in which compounds are sought that interact with specific regions of the kinase. Thus, the soluble polypeptide that competes with the target kinase region is designed to contain peptide sequences corresponding to the region of interest.

To perform cell free drug screening assays, it is sometimes desirable to immobilize either the kinase protein, or fragment, or its target molecule to facilitate separation of complexes from uncomplexed forms of one or both of the proteins, as well as to accommodate automation of the assay.

Techniques for immobilizing proteins on matrices can be used in the drug screening assays. In one embodiment, a fusion protein can be provided which adds a domain that allows the protein to be bound to a matrix. For example, glutathione-S-transferase fusion proteins can be adsorbed onto glutathione sepharose beads (Sigma Chemical, St.

Louis, Mo.) or glutathione derivatized microtitre plates, which are then combined with the cell lysates (e.g., $^{35}$S-labeled) and the candidate compound, and the mixture incubated under conditions conducive to complex formation (e.g., at physiological conditions for salt and pH). Following incubation, the beads are washed to remove any unbound label, and the matrix immobilized and radiolabel determined directly, or in the supernatant after the complexes are dissociated. Alternatively, the complexes can be dissociated from the matrix, separated by SDS-PAGE, and the level of kinase-binding protein found in the bead fraction quantitated from the gel using standard electrophoretic techniques. For example, either the polypeptide or its target molecule can be immobilized utilizing conjugation of biotin and streptayidin using techniques well known in the art. Alternatively, antibodies reactive with the protein but which do not interfere with binding of the protein to its target molecule can be derivatized to the wells of the plate, and the protein trapped in the wells by antibody conjugation. Preparations of a kinase-binding protein and a candidate compound are incubated in the kinase protein-presenting wells and the amount of complex trapped in the well can be quantitated. Methods for detecting such complexes, in addition to those described above for the GST-immobilized complexes, include immunodetection of complexes using antibodies reactive with the kinase protein target molecule, or which are reactive with kinase protein and compete with the target molecule, as well as enzyme-linked assays which rely on detecting an enzymatic activity associated with the target molecule.

Agents that modulate one of the kinases of the present invention can be identified using one or more of the above assays, alone or in combination. It is generally preferable to use a cell-based or cell free system first and then confirm activity in an animal or other model system. Such model systems are well known in the art and can readily be employed in this context.

Modulators of kinase protein activity identified according to these drug screening assays can be used to treat a subject with a disorder mediated by the kinase pathway, by treating cells or tissues that express the kinase. Experimental data as provided in FIG. 1 indicates expression in humans in testis, nervous tissue, kidney tumors, fetal brain, and a pooled fetal lung/testis/B-cell sample. These methods of treatment include the steps of administering a modulator of kinase activity in a pharmaceutical composition to a subject in need of such treatment, the modulator being identified as described herein.

In yet another aspect of the invention, the kinase proteins can be used as "bait proteins" in a two-hybrid assay or three-hybrid assay (see, e.g., U.S. Pat. No. 5,283,317; Zervos et al. (1993) *Cell* 72:223–232; Madura et al. (1993) *J. Biol. Chem.* 268:12046–12054; Bartel et al. (1993) *Biotechniques* 14:920–924; Iwabuchi et al. (1993) *Oncogene* 8:1693–1696; and Brent WO94/10300), to identify other proteins, which bind to or interact with the kinase and are involved in kinase activity. Such kinase-binding proteins are also likely to be involved in the propagation of signals by the kinase proteins or kinase targets as, for example, downstream elements of a kinase-mediated signaling pathway. Alternatively, such kinase-binding proteins are likely to be kinase inhibitors.

The two-hybrid system is based on the modular nature of most transcription factors, which consist of separable DNA-binding and activation domains. Briefly, the assay utilizes two different DNA constructs. In one construct, the gene that codes for a kinase protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a kinase-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the kinase protein.

This invention further pertains to novel agents identified by the above-described screening assays. Accordingly, it is within the scope of this invention to further use an agent identified as described herein in an appropriate animal model. For example, an agent identified as described herein (e.g., a kinase-modulating agent, an antisense kinase nucleic acid molecule, a kinase-specific antibody, or a kinase-binding partner) can be used in an animal or other model to determine the efficacy, toxicity, or side effects of treatment with such an agent. Alternatively, an agent identified as described herein can be used in an animal or other model to determine the mechanism of action of such an agent. Furthermore, this invention pertains to uses of novel agents identified by the above-described screening assays for treatments as described herein.

The kinase proteins of the present invention are also useful to provide a target for diagnosing a disease or predisposition to disease mediated by the peptide. Accordingly, the invention provides methods for detecting the presence, or levels of, the protein (or encoding mRNA) in a cell, tissue, or organism. Experimental data as provided in FIG. 1 indicates expression in humans in testis, nervous tissue, kidney tumors, fetal brain, and a pooled fetal lung/testis/B-cell sample. The method involves contacting a biological sample with a compound capable of interacting with the kinase protein such that the interaction can be detected. Such an assay can be provided in a single detection format or a multi-detection format such as an antibody chip array.

One agent for detecting a protein in a sample is an antibody capable of selectively binding to protein. A biological sample includes tissues, cells and biological fluids isolated from a subject, as well as tissues, cells and fluids present within a subject.

The peptides of the present invention also provide targets for diagnosing active protein activity, disease, or predisposition to disease, in a patient having a variant peptide, particularly activities and conditions that are known for other members of the family of proteins to which the present one belongs. Thus, the peptide can be isolated from a biological sample and assayed for the presence of a genetic mutation that results in aberrant peptide. This includes amino acid substitution, deletion, insertion, rearrangement, (as the result of aberrant splicing events), and inappropriate post-translational modification.

Analytic methods include altered electrophoretic mobility, altered tryptic peptide digest, altered kinase activity in cell-based or cell-free assay, alteration in substrate or antibody-binding pattern, altered isoelectric point, direct amino acid sequencing, and any other of the known assay techniques useful for detecting mutations in a protein. Such an assay can be provided in a single detection format or a multi-detection format such as an antibody chip array.

In vitro techniques for detection of peptide include enzyme linked immunosorbent assays (ELISAs), Western blots, immunoprecipitations and immunofluorescence using a detection reagent, such as an antibody or protein binding agent. Alternatively, the peptide can be detected in vivo in a subject by introducing into the subject a labeled anti-peptide antibody or other types of detection agent. For example, the antibody can be labeled with a radioactive marker whose presence and location in a subject can be detected by standard imaging techniques. Particularly useful are methods that detect the allelic variant of a peptide expressed in a subject and methods which detect fragments of a peptide in a sample.

The peptides are also useful in pharmacogenomic analysis. Pharmacogenomics deal with clinically significant hereditary variations in the response to drugs due to altered drug disposition and abnormal action in affected persons. See, e.g., Eichelbaum, M. (*Clin. Exp. Pharmacol. Physiol.* 23(10–11):983–985 (1996)), and Linder, M. W. (*Clin. Chem.* 43(2):254–266 (1997)). The clinical outcomes of these variations result in severe toxicity of therapeutic drugs in certain individuals or therapeutic failure of drugs in certain individuals as a result of individual variation in metabolism. Thus, the genotype of the individual can determine the way a therapeutic compound acts on the body or the way the body metabolizes the compound. Further, the activity of drug metabolizing enzymes effects both the intensity and duration of drug action. Thus, the pharmacogenomics of the individual permit the selection of effective compounds and effective dosages of such compounds for prophylactic or therapeutic treatment based on the individual's genotype. The discovery of genetic polymorphisms in some drug metabolizing enzymes has explained why some patients do not obtain the expected drug effects, show an exaggerated drug effect, or experience serious toxicity from standard drug dosages. Polymorphisms can be expressed in the phenotype of the extensive metabolizer and the phenotype of the poor metabolizer. Accordingly, genetic polymorphism may lead to allelic protein variants of the kinase protein in which one or more of the kinase functions in one population is different from those in another population. The peptides thus allow a target to ascertain a genetic predisposition that can affect treatment modality. Thus, in a ligand-based treatment, polymorphism may give rise to amino terminal extracellular domains and/or other substrate-binding regions that are more or less active in substrate binding, and kinase activation. Accordingly, substrate dosage would necessarily be modified to maximize the therapeutic effect within a given population containing a polymorphism. As an alternative to genotyping, specific polymorphic peptides could be identified.

The peptides are also useful for treating a disorder characterized by an absence of, inappropriate, or unwanted expression of the protein. Experimental data as provided in FIG. 1 indicates expression in humans in testis, nervous tissue, kidney tumors, fetal brain, and a pooled fetal lung/testis/B-cell sample. Accordingly, methods for treatment include the use of the kinase protein or fragments.

Antibodies

The invention also provides antibodies that selectively bind to one of the peptides of the present invention, a protein comprising such a peptide, as well as variants and fragments thereof. As used herein, an antibody selectively binds a target peptide when it binds the target peptide and does not significantly bind to unrelated proteins. An antibody is still considered to selectively bind a peptide even if it also binds to other proteins that are not substantially homologous with the target peptide so long as such proteins share homology with a fragment or domain of the peptide target of the antibody. In this case, it would be understood that antibody binding to the peptide is still selective despite some degree of cross-reactivity.

As used herein, an antibody is defined in terms consistent with that recognized within the art: they are multi-subunit proteins produced by a mammalian organism in response to an antigen challenge. The antibodies of the present invention include polyclonal antibodies and monoclonal antibodies, as well as fragments of such antibodies, including, but not limited to, Fab or $F(ab')_2$, and Fv fragments.

Many methods are known for generating and/or identifying antibodies to a given target peptide. Several such methods are described by Harlow, Antibodies, Cold Spring Harbor Press, (1989).

In general, to generate antibodies, an isolated peptide is used as an immunogen and is administered to a mammalian organism, such as a rat, rabbit or mouse. The full-length protein, an antigenic peptide fragment or a fusion protein can be used. Particularly important fragments are those covering functional domains, such as the domains identified in FIG. 2, and domain of sequence homology or divergence amongst the family, such as those that can readily be identified using protein alignment methods and as presented in the Figures.

Antibodies are preferably prepared from regions or discrete fragments of the kinase proteins. Antibodies can be prepared from any region of the peptide as described herein. However, preferred regions will include those involved in function/activity and/or kinase/binding partner interaction. FIG. 2 can be used to identify particularly important regions while sequence alignment can be used to identify conserved and unique sequence fragments.

An antigenic fragment will typically comprise at least 8 contiguous amino acid residues. The antigenic peptide can comprise, however, at least 10, 12, 14, 16 or more amino acid residues. Such fragments can be selected on a physical property, such as fragments correspond to regions that are located on the surface of the protein, e.g., hydrophilic regions or can be selected based on sequence uniqueness (see FIG. 2).

Detection on an antibody of the present invention can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Antibody Uses

The antibodies can be used to isolate one of the proteins of the present invention by standard techniques, such as affinity chromatography or immunoprecipitation. The antibodies can facilitate the purification of the natural protein from cells and recombinantly produced protein expressed in host cells. In addition, such antibodies are useful to detect the presence of one of the proteins of the present invention in cells or tissues to determine the pattern of expression of the protein among various tissues in an organism and over the course of normal development. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain. Further, such antibodies can be used to detect protein in situ, in vitro, or in a cell lysate or supernatant in order to evaluate the abundance and pattern of expression. Also, such antibodies can be used to assess abnormal tissue distribution or abnormal expression during development or progression of a biological condition. Antibody detection of circulating fragments of the full length protein can be used to identify turnover.

Further, the antibodies can be used to assess expression in disease states such as in active stages of the disease or in an individual with a predisposition toward disease related to the protein's function. When a disorder is caused by an inappropriate tissue distribution, developmental expression, level of expression of the protein, or expressed/processed form, the antibody can be prepared against the normal protein. Experimental data as provided in FIG. 1 indicates expression in humans in testis, nervous tissue, kidney tumors, fetal brain, and a pooled fetal lung/testis/B-cell sample. If a disorder is characterized by a specific mutation in the protein, antibodies specific for this mutant protein can be used to assay for the presence of the specific mutant protein.

The antibodies can also be used to assess normal and aberrant subcellular localization of cells in the various tissues in an organism. Experimental data as provided in FIG. 1 indicates expression in humans in testis, nervous tissue, kidney tumors, fetal brain, and a pooled fetal lung/testis/B-cell sample. The diagnostic uses can be applied, not only in genetic testing, but also in monitoring a treatment modality. Accordingly, where treatment is ultimately aimed at correcting expression level or the presence of aberrant sequence and aberrant tissue distribution or developmental expression, antibodies directed against the protein or relevant fragments can be used to monitor therapeutic efficacy.

Additionally, antibodies are useful in pharmacogenomic analysis. Thus, antibodies prepared against polymorphic proteins can be used to identify individuals that require modified treatment modalities. The antibodies are also useful as diagnostic tools as an immunological marker for aberrant protein analyzed by electrophoretic mobility, isoelectric point, tryptic peptide digest, and other physical assays known to those in the art.

The antibodies are also useful for tissue typing. Experimental data as provided in FIG. 1 indicates expression in humans in testis, nervous tissue, kidney tumors, fetal brain, and a pooled fetal lung/testis/B-cell sample. Thus, where a specific protein has been correlated with expression in a specific tissue, antibodies that are specific for this protein can be used to identify a tissue type.

The antibodies are also useful for inhibiting protein function, for example, blocking the binding of the kinase peptide to a binding partner such as a substrate. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated with a cell or cell membrane. See FIG. 2 for structural information relating to the proteins of the present invention.

The invention also encompasses kits for using antibodies to detect the presence of a protein in a biological sample. The kit can comprise antibodies such as a labeled or labelable antibody and a compound or agent for detecting protein in a biological sample; means for determining the amount of protein in the sample; means for comparing the amount of protein in the sample with a standard; and instructions for use. Such a kit can be supplied to detect a single protein or epitope or can be configured to detect one of a multitude of epitopes, such as in an antibody detection array. Arrays are described in detail below for nuleic acid arrays and similar methods have been developed for antibody arrays.

Nucleic Acid Molecules

The present invention further provides isolated nucleic acid molecules that encode a kinase peptide or protein of the present invention (cDNA, transcript and genomic sequence). Such nucleic acid molecules will consist of, consist essentially of, or comprise a nucleotide sequence that encodes one of the kinase peptides of the present invention, an allelic variant thereof, or an ortholog or paralog thereof.

As used herein, an "isolated" nucleic acid molecule is one that is separated from other nucleic acid present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. However, there can be some flanking nucleotide sequences, for example up to about 5KB, 4KB, 3KB, 2KB, or 1KB or less, particularly contiguous peptide encoding sequences and peptide encoding sequences within the same gene but separated by introns in the genomic sequence. The important point is that the nucleic acid is isolated from remote and unimportant flanking sequences such that it can be subjected to the specific manipulations described herein such as recombinant expression, preparation of probes and primers, and other uses specific to the nucleic acid sequences.

Moreover, an "isolated" nucleic acid molecule, such as a transcript/cDNA molecule, can be substantially free of other cellular material, or culture medium when produced by recombinant techniques, or chemical precursors.or other chemicals when chemically synthesized. However, the nucleic acid molecule can be fused to other coding or regulatory sequences and still be considered isolated.

For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated DNA molecules of the present invention. Isolated nucleic acid molecules according to the present invention further include such molecules produced synthetically.

Accordingly, the present invention provides nucleic acid molecules that consist of the nucleotide sequence shown in FIG. 1 or 3 (SEQ ID NO: 1, transcript sequence and SEQ ID NO:3, genomic sequence), or any nucleic acid molecule that encodes the protein provided in FIG. 2, SEQ ID NO:2. A nucleic acid molecule consists of a nucleotide sequence when the nucleotide sequence is the complete nucleotide sequence of the nucleic acid molecule.

The present invention further provides nucleic acid molecules that consist essentially of the nucleotide sequence shown in FIG. 1 or 3 (SEQ ID NO:1, transcript sequence and SEQ ID NO:3, genomic sequence), or any nucleic acid molecule that encodes the protein provided in FIG. 2, SEQ ID NO:2. A nucleic acid molecule consists essentially of a nucleotide sequence when such a nucleotide sequence is present with only a few additional nucleic acid residues in the final nucleic acid molecule.

The present invention further provides nucleic acid molecules that comprise the nucleotide sequences shown in FIG. 1 or 3 (SEQ ID NO:1, transcript sequence and SEQ ID NO:3, genomic sequence), or any nucleic acid molecule that encodes the protein provided in FIG. 2, SEQ ID NO:2. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleic acid residues, such as nucleic acid residues that are naturally associated with it or heterologous nucleotide sequences. Such a nucleic acid molecule can have a few additional nucleotides or can comprises several hundred or more additional nucleotides. A brief description of how various types of these nucleic acid molecules can be readily made/isolated is provided below.

In FIGS. 1 and 3, both coding and non-coding sequences are provided. Because of the source of the present invention, humans genomic sequence (FIG. 3) and cDNA/transcript sequences (FIG. 1), the nucleic acid molecules in the Figures will contain genomic intronic sequences, 5' and 3' non-coding sequences, gene regulatory regions and non-coding intergenic sequences. In general such sequence features are either noted in FIGS. 1 and 3 or can readily be identified using computational tools known in the art. As discussed below, some of the non-coding regions, particularly gene regulatory elements such as promoters, are useful for a variety of purposes, e.g. control of heterologous gene expression, target for identifying gene activity modulating compounds, and are particularly claimed as fragments of the genomic sequence provided herein.

The isolated nucleic acid molecules can encode the mature protein plus additional amino or carboxyl-terminal amino acids, or amino acids interior to the mature peptide (when the mature form has more than one peptide chain, for instance). Such sequences may play a role in processing of a protein from precursor to a mature form, facilitate protein trafficking, prolong or shorten protein half-life or facilitate manipulation of a protein for assay or production, among other things. As generally is the case in situ, the additional amino acids may be processed away from the mature protein by cellular enzymes.

As mentioned above, the isolated nucleic acid molecules include, but are not limited to, the sequence encoding the kinase peptide alone, the sequence encoding the mature peptide and additional coding sequences, such as a leader or secretory sequence (e.g., a pre-pro or pro-protein sequence), the sequence encoding the mature peptide, with or without the additional coding sequences, plus additional non-coding sequences, for example introns and non-coding 5' and 3' sequences such as transcribed but non-translated sequences that play a role in transcription, mRNA processing (including splicing and polyadenylation signals), ribosome binding and stability of mRNA. In addition, the nucleic acid molecule may be fused to a marker sequence encoding, for example, a peptide that facilitates purification.

Isolated nucleic acid molecules can be in the form of RNA, such as mRNA, or in the form DNA, including cDNA and genomic DNA obtained by cloning or produced by chemical synthetic techniques or by a combination thereof. The nucleic acid, especially DNA, can be double-stranded or single-stranded. Single-stranded nucleic acid can be the coding strand (sense strand) or the non-coding strand (anti-sense strand).

The invention further provides nucleic acid molecules that encode fragments of the peptides of the present invention as well as nucleic acid molecules that encode obvious variants of the kinase proteins of the present invention that are described above. Such nucleic acid molecules may be naturally occurring, such as allelic variants (same locus), paralogs (different locus), and orthologs (different organism), or may be constructed by recombinant DNA methods or by chemical synthesis. Such non-naturally occurring variants may be made by mutagenesis techniques, including those applied to nucleic acid molecules, cells, or organisms. Accordingly, as discussed above, the variants can contain nucleotide substitutions, deletions, inversions and insertions. Variation can occur in either or both the coding and non-coding regions. The variations can produce both conservative and non-conservative amino acid substitutions.

The present invention further provides non-coding fragments of the nucleic acid molecules provided in FIGS. 1 and 3. Preferred non-coding fragments include, but are not limited to, promoter sequences, enhancer sequences, gene modulating sequences and gene termination sequences. Such fragments are useful in controlling heterologous gene expression and in developing screens to identify gene-modulating agents. A promoter can readily be identified as being 5' to the ATG start site in the genomic sequence provided in FIG. 3.

A fragment comprises a contiguous nucleotide sequence greater than 12 or more nucleotides. Further, a fragment could at least 30, 40, 50, 100, 250 or 500 nucleotides in length. The length of the fragment will be based on its intended use. For example, the fragment can encode epitope bearing regions of the peptide, or can be useful as DNA probes and primers. Such fragments can be isolated using the known nucleotide sequence to synthesize an oligonucleotide probe. A labeled probe can then be used to screen a cDNA library, genomic DNA library, or mRNA to isolate nucleic acid corresponding to the coding region. Further, primers can be used in PCR reactions to clone specific regions of gene.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides.

Orthologs, homologs, and allelic variants can be identified using methods well known in the art. As described in the Peptide Section, these variants comprise a nucleotide sequence encoding a peptide that is typically 60–70%, 70–80%, 80–90%, and more typically at least about 90–95% or more homologous to the nucleotide sequence shown in the Figure sheets or a fragment of this sequence. Such nucleic acid molecules can readily be identified as being able to hybridize under moderate to stringent conditions, to the nucleotide sequence shown in the Figure sheets or a fragment of the sequence. Allelic variants can readily be determined by genetic locus of the encoding gene. The gene encoding the novel kinase protein of the present invention is located on a genome component that has been mapped to human chromosome 3 (as indicated in FIG. 3), which is supported by multiple lines of evidence, such as STS and BAC map data.

FIG. 3 provides information on SNPs that have been found in the gene encoding the kinase protein of the present invention. SNPs were identified at 208 different nucleotide positions. These SNPs are all located in introns and may affect control/regulatory elements.

As used herein, the term "hybridizes under stringent conditions" is intended to describe conditions for hybridization and washing under which nucleotide sequences encoding a peptide at least 60–70% homologous to each other typically remain hybridized to each other. The conditions can be such that sequences at least about 60%, at least about 70%, or at least about 80% or more homologous to each other typically remain hybridized to each other. Such stringent conditions are known to those skilled in the art and can be found in *Current Protocols in Molecular Biology*, John Wiley & Sons, N.Y. (1989), 6.3.1–6.3.6. One example of stringent hybridization conditions are hybridization in 6×sodium chloride/sodium citrate (SSC) at about 45C, followed by one or more washes in 0.2× SSC, 0.1% SDS at 50–65C. Examples of moderate to low stringency hybridization conditions are well known in the art.

Nucleic Acid Molecule Uses

The nucleic acid molecules of the present invention are useful for probes, primers, chemical intermediates, and in biological assays. The nucleic acid molecules are useful as a hybridization probe for messenger RNA, transcript/cDNA and genomic DNA to isolate full-length cDNA and genomic clones encoding the peptide described in FIG. 2 and to isolate cDNA and genomic clones that correspond to variants (alleles, orthologs, etc.) producing the same or related peptides shown in FIG. 2. As illustrated in FIG. 3, SNPs were identified at 208 different nucleotide positions.

The probe can correspond to any sequence along the entire length of the nucleic acid molecules provided in the Figures. Accordingly, it could be derived from 5' noncoding regions, the coding region, and 3' noncoding regions. However, as discussed, fragments are not to be construed as encompassing fragments disclosed prior to the present invention.

The nucleic acid molecules are also useful as primers for PCR to amplify any given region of a nucleic acid molecule and are useful to synthesize antisense molecules of desired length and sequence.

The nucleic acid molecules are also useful for constructing recombinant vectors. Such vectors include expression vectors that express a portion of, or all of, the peptide sequences. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced mutations.

The nucleic acid molecules are also useful for expressing antigenic portions of the proteins.

The nucleic acid molecules are also useful as probes for determining the chromosomal positions of the nucleic acid molecules by means of in situ hybridization methods. The gene encoding the novel kinase protein of the present invention is located on a genome component that has been mapped to human chromosome 3 (as indicated in FIG. 3), which is supported by multiple lines of evidence, such as STS and BAC map data.

The nucleic acid molecules are also useful in making vectors containing the gene regulatory regions of the nucleic acid molecules of the present invention.

The nucleic acid molecules are also useful for designing ribozymes corresponding to all, or a part, of the mRNA produced from the nucleic acid molecules described herein.

The nucleic acid molecules are also useful for making vectors that express part, or all, of the peptides.

The nucleic acid molecules are also useful for constructing host cells expressing a part, or all, of the nucleic acid molecules and peptides.

The nucleic acid molecules are also useful for constructing transgenic animals expressing all, or a part, of the nucleic acid molecules and peptides.

The nucleic acid molecules are also useful as hybridization probes for determining the presence, level, form and distribution of nucleic acid expression. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain. Accordingly, the probes can be used to detect the presence of, or to determine levels of, a specific nucleic acid molecule in cells, tissues, and in organisms. The nucleic acid whose level is determined can be DNA or RNA. Accordingly, probes corresponding to the peptides described herein can be used to assess expression and/or gene copy number in a given cell, tissue, or organism. These uses are relevant for diagnosis of disorders involving an increase or decrease in kinase protein expression relative to normal results.

In vitro techniques for detection of mRNA include Northern hybridizations and in situ hybridizations. In vitro techniques for detecting DNA includes Southern hybridizations and in situ hybridization.

Probes can be used as a part of a diagnostic test kit for identifying cells or tissues that express a kinase protein, such as by measuring a level of a kinase-encoding nucleic acid in a sample of cells from a subject e.g., mRNA or genomic DNA, or determining if a kinase gene has been mutated. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain.

Nucleic acid expression assays are useful for drug screening to identify compounds that modulate kinase nucleic acid expression.

The invention thus provides a method for identifying a compound that can be used to treat a disorder associated with nucleic acid expression of the kinase gene, particularly biological and pathological processes that are mediated by the kinase in cells and tissues that express it. Experimental data as provided in FIG. 1 indicates expression in humans in testis, nervous tissue, kidney tumors, fetal brain, and a pooled fetal lung/testis/B-cell sample. The method typically includes assaying the ability of the compound to modulate the expression of the kinase nucleic acid and thus identifying a compound that can be used to treat a disorder characterized by undesired kinase nucleic acid expression. The assays can be performed in cell-based and cell-free systems. Cell-based assays include cells naturally expressing the kinase nucleic acid or recombinant cells genetically engineered to express specific nucleic acid sequences.

The assay for kinase nucleic acid expression can involve direct assay of nucleic acid levels, such as mRNA levels, or on collateral compounds involved in the signal pathway. Further, the expression of genes that are up- or down-regulated in response to the kinase protein signal pathway can also be assayed. In this embodiment the regulatory regions of these genes can be operably linked to a reporter gene such as luciferase.

Thus, modulators of kinase gene expression can be identified in a method wherein a cell is contacted with a candidate compound and the expression of mRNA determined. The level of expression of kinase mRNA in the presence of the candidate compound is compared to the level of expression of kinase mRNA in the absence of the candidate compound. The candidate compound can then be identified as a modulator of nucleic acid expression based on this comparison and be used, for example to treat a disorder characterized by aberrant nucleic acid expression. When expression of mRNA is statistically significantly greater in the presence-of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the nucleic acid as a target, using a compound identified through drug screening as a gene modulator to modulate kinase nucleic acid expression in cells and tissues that express the kinase. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain. Modulation includes both up-regulation (i.e. activation or agonization) or down-regulation (suppression or antagonization) or nucleic acid expression.

Alternatively, a modulator for kinase nucleic acid expression can be a small molecule or drug identified using the screening assays described herein as long as the drug or small molecule inhibits the kinase nucleic acid expression in the cells and tissues that express the protein. Experimental data as provided in FIG. 1 indicates expression in humans in testis, nervous tissue, kidney tumors, fetal brain, and a pooled fetal lung/testis/B-cell sample.

The nucleic acid molecules are also useful for monitoring the effectiveness of modulating compounds on the expression or activity of the kinase gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

The nucleic acid molecules are also useful in diagnostic assays for qualitative changes in kinase nucleic acid expression, and particularly in qualitative changes that lead to pathology. The nucleic acid molecules can be used to detect mutations in kinase genes and gene expression products such as mRNA. The nucleic acid molecules can be used as hybridization probes to detect naturally occurring genetic mutations in the kinase gene and thereby to determine whether a subject with the mutation is at risk for a disorder caused by the mutation. Mutations include deletion, addition, or substitution of one or more nucleotides in the gene, chromosomal rearrangement, such as inversion or transposition, modification of genomic DNA, such as aberrant methylation patterns or changes in gene copy number, such as amplification. Detection of a mutated form of the kinase gene associated with a dysfunction provides a diagnostic tool for an active disease or susceptibility to disease when the disease results from overexpression, underexpression, or altered expression of a kinase protein.

Individuals carrying mutations in the kinase gene can be detected at the nucleic acid level by a variety of techniques. FIG. 3 provides information on SNPs that have been found in the gene encoding the kinase protein of the present invention. SNPs were identified at 208 different nucleotide positions. These SNPs are all located in introns and may affect control/regulatory elements. The gene encoding the novel kinase protein of the present invention is located on a genome component that has been mapped to human chromosome 3 (as indicated in FIG. 3), which is supported by multiple lines of evidence, such as STS and BAC map data. Genomic DNA can be analyzed directly or can be amplified by using PCR prior to analysis. RNA or cDNA can be used in the same way. In some uses, detection of the mutation involves the use of a probe/primer in a polymerase chain reaction (PCR) (see, e.g. U.S. Pat. Nos. 4,683,195 and 4,683,202), such as anchor PCR or RACE PCR, or, alternatively, in a ligation chain reaction (LCR) (see, e.g., Landegran et al., *Science* 241:1077–1080 (1988); and Nakazawa et al., *PNAS* 91:360–364 (1994)), the latter of which can be particularly useful for detecting point mutations in the gene (see Abravaya et al., *Nucleic Acids Res.* 23:675–682 (1995)). This method can include the steps of collecting a sample of cells from a patient, isolating nucleic acid (e.g., genomic, mRNA or both) from the cells of the sample, contacting the nucleic acid sample with one or more primers which specifically hybridize to a gene under conditions such that hybridization and amplification of the gene (if present) occurs, and detecting the presence or absence of an amplification product, or detecting the size of the amplification product and comparing the length to a control sample. Deletions and insertions can be detected by a change in size of the amplified product compared to the normal genotype. Point mutations can be identified by hybridizing amplified DNA to normal RNA or antisense DNA sequences.

Alternatively, mutations in a kinase gene can be directly identified, for example, by alterations in restriction enzyme digestion patterns determined by gel electrophoresis.

Further, sequence-specific ribozymes (U.S. Pat. No. 5,498,531) can be used to score for the presence of specific mutations by development or loss of a ribozyme cleavage site. Perfectly matched sequences can be distinguished from mismatched sequences by nuclease cleavage digestion assays or by differences in melting temperature.

Sequence changes at specific locations can also be assessed by nuclease protection assays such as RNase and S1 protection or the chemical cleavage method. Furthermore, sequence differences between a mutant kinase gene and a wild-type gene can be determined by direct DNA sequencing. A variety of automated sequencing procedures can be utilized when performing the diagnostic assays (Naeve, C. W., (1995) *Biotechniques* 19:448), including sequencing by mass spectrometry (see, e.g., PCT International Publication No. WO 94/16101; Cohen et al., *Adv. Chromatogr.* 36:127–162 (1996); and Griffin et al., *Appl. Biochem. Biotechnol.* 38:147–159 (1993)).

Other methods for detecting mutations in the gene include methods in which protection from cleavage agents is used to detect mismatched bases in RNA/RNA or RNA/DNA duplexes (Myers et al., *Science* 230:1242 (1985)); Cotton et al., *PNAS* 85:4397 (1988); Saleeba et al., *Meth. Enzymol.* 217:286–295 (1992)), electrophoretic mobility of mutant and wild type nucleic acid is compared (Orita et al., *PNAS* 86:2766 (1989); Cotton et al., *Mutat. Res.* 285:125–144 (1993); and Hayashi et al., *Genet. Anal. Tech. Appl.* 9:73–79 (1992)), and movement of mutant or wild-type fragments in polyacrylamide gels containing a gradient of denaturant is assayed using denaturing gradient gel electrophoresis (Myers et al., *Nature* 313:495 (1985)). Examples of other techniques for detecting point mutations include selective oligonucleotide hybridization, selective amplification, and selective primer extension.

The nucleic acid molecules are also useful for testing an individual for a genotype that while not necessarily causing the disease, nevertheless affects the treatment modality. Thus, the nucleic acid molecules can be used to study the relationship between an individual's genotype and the individual's response to a compound used for treatment (pharmacogenomic relationship). Accordingly, the nucleic acid molecules described herein can be used to assess the mutation content of the kinase gene in an individual in order to select an appropriate compound or dosage regimen for treatment. FIG. 3 provides information on SNPs that have been found in the gene encoding the kinase protein of the present invention. SNPs were identified at 208 different nucleotide positions. These SNPs are all located in introns and may affect control/regulatory elements.

Thus nucleic acid molecules displaying genetic variations that affect treatment provide a diagnostic target that can be used to tailor treatment in an individual. Accordingly, the production of recombinant cells and animals containing these polymorphisms allow effective clinical design of treatment compounds and dosage regimens.

The nucleic acid molecules are thus useful as antisense constructs to control kinase gene expression in cells, tissues, and organisms. A DNA antisense nucleic acid molecule is designed to be complementary to a region of the gene involved in transcription, preventing transcription and hence production of kinase protein. An antisense RNA or DNA nucleic acid molecule would hybridize to the mRNA and thus block translation of mRNA into kinase protein.

Alternatively, a class of antisense molecules can be used to inactivate mRNA in order to decrease expression of kinase nucleic acid. Accordingly, these molecules can treat a disorder characterized by abnormal or undesired kinase nucleic acid expression. This technique involves cleavage by means of ribozymes containing nucleotide sequences complementary to one or more regions in the mRNA that attenuate the ability of the mRNA to be translated. Possible regions include coding regions and particularly coding regions corresponding to the catalytic and other functional activities of the kinase protein, such as substrate binding.

The nucleic acid molecules also provide vectors for gene therapy in patients containing cells that are aberrant in kinase gene expression. Thus, recombinant cells, which include the patient's cells that have been engineered ex vivo and returned to the patient, are introduced into an individual where the cells produce the desired kinase protein to treat the individual.

The invention also encompasses kits for detecting the presence of a kinase nucleic acid in a biological sample. Experimental data as provided in FIG. 1 indicates that kinase proteins of the present invention are expressed in humans in testis, nervous tissue, kidney tumors, and a pooled fetal lung/testis/B-cell sample, as indicated by virtual northern blot analysis. In addition, PCR-based tissue screening panels indicate expression in fetal brain. For example, the kit can comprise reagents such as a labeled or labelable nucleic acid or agent capable of detecting kinase nucleic acid in a biological sample; means for determining the amount of kinase nucleic acid in the sample; and means for comparing the amount of kinase nucleic acid in the sample with a standard. The compound or agent can be packaged in a suitable container. The kit can further comprise instructions for using the kit to detect kinase protein mRNA or DNA.

Nucleic Acid Arrays

The present invention further provides nucleic acid detection kits, such as arrays or microarrays of nucleic acid molecules that are based on the sequence information provided in FIGS. 1 and 3 (SEQ ID NOS:1 and 3).

As used herein "Arrays" or "Microarrays" refers to an array of distinct polynucleotides or oligonucleotides synthesized on a substrate, such as paper, nylon or other type of membrane, filter, chip, glass slide, or any other suitable solid support. In one embodiment, the microarray is prepared and used according to the methods described in U.S. Pat. No. 5,837,832, Chee et al., PCT application WO95/11995 (Chee et al.), Lockhart, D. J. et al. (1996; Natl. Biotech. 14: 1675–1680) and Schena, M. et al. (1996; Proc. Natl. Acad. Sci. 93: 10614–10619), all of which are incorporated herein in their entirety by reference. In other embodiments, such arrays are produced by the methods described by Brown et al., U.S. Pat. No. 5,807,522.

The microarray or detection kit is preferably composed of a large number of unique, single-stranded nucleic acid sequences, usually either synthetic antisense oligonucleotides or fragments of cDNAs, fixed to a solid support. The oligonucleotides are preferably about 6–60 nucleotides in length, more preferably 15–30 nucleotides in length, and most preferably about 20–25 nucleotides in length. For a certain type of microarray or detection kit, it may be preferable to use oligonucleotides that are only 7–20 nucleotides in length. The microarray or detection kit may contain oligonucleotides that cover the known 5', or 3', sequence, sequential oligonucleotides which cover the full length sequence; or unique oligonucleotides selected from particular areas along the length of the sequence. Polynucleotides used in the microarray or detection kit may be oligonucleotides that are specific to a gene or genes of interest.

In order to produce oligonucleotides to a known sequence for a microarray or detection-kit, the gene(s) of interest (or an ORF identified from the contigs of the present invention) is typically examined using a computer algorithm which starts at the 5' or at the 3' end of the nucleotide sequence. Typical algorithms will then identify oligomers of defined length that are unique to the gene, have a GC content within a range suitable for hybridization, and lack predicted secondary structure that may interfere with hybridization. In certain situations it may be appropriate to use pairs of oligonucleotides on a microarray or detection kit. The "pairs" will be identical, except for one nucleotide that preferably is located in the center of the sequence. The second oligonucleotide in the pair (mismatched by one) serves as a control. The number of oligonucleotide pairs may range from two to one million. The oligomers are synthesized at designated areas on a substrate using a light-directed chemical process. The substrate may be paper, nylon or other type of membrane, filter, chip, glass slide or any other suitable solid support.

In another aspect, an oligonucleotide may be synthesized on the surface of the substrate by using a chemical coupling procedure and an ink jet application apparatus, as described in PCT application WO95/25 1116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more oligonucleotides, or any other number between two and one million which lends itself to the efficient use of commercially available instrumentation.

In order to conduct sample analysis using a microarray or detection kit, the RNA or DNA from a biological sample is made into hybridization probes. The mRNA is isolated, and cDNA is produced and used as a template to make antisense RNA (aRNA). The aRNA is amplified in the presence of fluorescent nucleotides, and labeled probes are incubated with the microarray or detection kit so that the probe sequences hybridize to complementary oligonucleotides of the microarray or detection kit. Incubation conditions are adjusted so that hybridization occurs with precise complementary matches or with various degrees of less complementarity. After removal of nonhybridized probes, a scanner is used to determine the levels and patterns of fluorescence. The scanned images are examined to determine degree of complementarity and the relative abundance of each oligonucleotide sequence on the microarray or detection kit. The biological samples may be obtained from any bodily fluids (such as blood, urine, saliva, phlegm, gastric juices, etc.), cultured cells, biopsies, or other tissue preparations. A detection system may be used to measure the absence, presence, and amount of hybridization for all of the distinct sequences simultaneously. This data may be used for large-scale correlation studies on the sequences, expression patterns, mutations, variants, or polymorphisms among samples.

Using such arrays, the present invention provides methods to identify the expression of the kinase proteins/peptides of the present invention. In detail, such methods comprise incubating a test sample with one or more nucleic acid molecules and assaying for binding of the nucleic acid molecule with components within the test sample. Such assays will typically involve arrays comprising many genes, at least one of which is a gene of the present invention and or alleles of the kinase gene of the present invention. FIG. 3 provides information on SNPs that have been found in the gene encoding the kinase protein of the present invention. SNPs were identified at 208 different nucleotide positions. These SNPs are all located in introns and may affect control/regulatory elements.

Conditions for incubating a nucleic acid molecule with a test sample vary. Incubation conditions depend on the format employed in the assay, the detection methods employed, and the type and nature of the nucleic acid molecule used in the assay. One skilled in the art will recognize that any one of the commonly available hybridization, amplification or array assay formats can readily be adapted to employ the novel fragments of the Human genome disclosed herein. Examples of such assays can be found in Chard, T, *An Introduction to Radioimmunoassay and Related Techniques*, Elsevier Science Publishers, Amsterdam, The Netherlands (1986); Bullock, G. R. et al., *Techniques in Immunocytochemistry*, Academic Press, Orlando, Fla. Vol. 1 (1982), Vol. 2(1983), Vol. 3(1985); Tijssen, P., *Practice and Theory of Enzyme Immunoassays: Laboratory Techniques in Biochemistry and Molecular Biology*, Elsevier Science Publishers, Amsterdam, The Netherlands (1985).

The test samples of the present invention include cells, protein or membrane extracts of cells. The test sample used in the above-described method will vary based on the assay format, nature of the detection method and the tissues, cells or extracts used as the sample to be assayed. Methods for preparing nucleic acid extracts or of cells are well known in the art and can be readily be adapted in order to obtain a sample that is compatible with the system utilized.

In another embodiment of the present invention, kits are provided which contain the necessary reagents to carry out the assays of the present invention.

Specifically, the invention provides a compartmentalized kit to receive, in close confinement, one or more containers which comprises: (a) a first container comprising one of the nucleic acid molecules that can bind to a fragment of the Human genome disclosed herein; and (b) one or more other containers comprising one or more of the following: wash reagents, reagents capable of detecting presence of a bound nucleic acid.

In detail, a compartmentalized kit includes any kit in which reagents are contained in separate containers. Such containers include small glass containers, plastic containers, strips of plastic, glass or paper, or arraying material such as silica. Such containers allows one to efficiently transfer reagents from one compartment to another compartment such that the samples and reagents are not cross-contaminated, and the agents or solutions of each container can be added in a quantitative fashion from one compartment to another; Such containers will include a container which will accept the test sample, a container which contains the nucleic acid probe, containers which contain wash reagents (such as phosphate buffered saline, Tris-buffers, etc.), and containers which contain the reagents used to detect the bound probe. One skilled in the art will readily recognize that the previously unidentified kinase gene of the present invention can be routinely identified using the sequence information disclosed herein can be readily incorporated into one of the established kit formats which are well known in the art, particularly expression arrays.

Vectors/Host Cells

The invention also provides vectors containing the nucleic acid molecules described herein. The term "vector" refers to a vehicle, preferably a nucleic acid molecule, which can transport the nucleic acid molecules. When the vector is a nucleic acid molecule, the nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extra-chromosomal element where it replicates and produces additional copies of the nucleic acid molecules. Alternatively, the vector may integrate into the host cell genome and produce additional copies of the nucleic acid molecules when the host cell replicates.

The invention provides vectors for the maintenance (cloning vectors) or vectors for expression (expression vectors) of the nucleic acid molecules. The vectors can function in prokaryotic or eukaryotic cells or in both (shuttle vectors).

Expression vectors contain cis-acting regulatory regions that are operably linked in the vector to the nucleic acid molecules such that transcription of the nucleic acid molecules is allowed in a host cell. The nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequence to which the nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., *Molecular Cloning: A Laboratory Manual*. 2nd. ed., Cold Spring Harbor Laboratory Press, Cold Spring Harbor, N.Y., (1989).

A variety of expression vectors can be used to express a nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, e.g. cosmids and phagemids. Appropriate cloning and expression vectors for prokaryotic and eukaryotic hosts are described in Sambrook et al., *Molecular Cloning: A Laboratory Manual*. 2nd. ed., Cold Spring Harbor Laboratory Press, Cold Spring Harbor, N.Y., (1989).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors providing for constitutive and inducible expression in prokaryotic and eukaryotic hosts are well known to those of ordinary skill in the art.

The nucleic acid molecules can be inserted into the vector nucleic acid by well-known methodology. Generally, the DNA sequence that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, *E. coli*, Streptomyces, and *Salmonella typhimurium*. Eukaryotic cells include, but are not limited to, yeast, insect cells such as Drosophila, animal cells such as COS and CHO cells, and plant cells.

As described herein, it may be desirable to express the peptide as a fusion protein. Accordingly, the invention provides fusion vectors that allow for the production of the peptides. Fusion vectors can increase the expression of a recombinant protein, increase the solubility of the recombinant protein, and aid in the purification of the protein by acting for example as a ligand for affinity purification. A proteolytic cleavage site may be introduced at the junction of the fusion moiety so that the desired peptide can ultimately be separated from the fusion moiety. Proteolytic enzymes include, but are not limited to, factor Xa, thrombin, and enterokinase. Typical fusion expression vectors include pGEX (Smith et al., *Gene* 67:31–40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301–315 (1988)) and pET 11*d* (Studier et al., *Gene Expression Technology: Methods in Enzymology* 185:60–89 (1990)).

Recombinant protein expression can be maximized in host bacteria by providing a genetic background wherein the host cell has an impaired capacity to proteolytically cleave the recombinant protein. (Gottesman, S., *Gene Expression Technology: Methods in Enzymology* 185, Academic Press, San Diego, Calif. (1990)119–128). Alternatively, the sequence of the nucleic acid molecule of interest can be altered to provide preferential codon usage for a specific host cell, for example *E. coli*. (Wada et al, *Nucleic Acids Res.* 20:2111–2118 (1992)).

The nucleic acid molecules can also be expressed by expression vectors that are operative in yeast. Examples of vectors for expression in yeast e.g., *S. cerevisiae* include pYepSec1 (Baldari, et al., *EMBO J.* 6:229–234 (1987)), pMFa (Kujan et al., *Cell* 30:933–943(1982)), pJRY88 (Schultz et al., *Gene* 54:113–123 (1987)), and pYES2 (Invitrogen Corporation, San Diego, Calif.).

The nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156–2165 (1983)) and the pVL series (Lucklow etal., *Virology* 170:31–39 (1989)).

In certain embodiments of the invention, the nucleic acid molecules described herein are expressed in mammalian cells using mammalian expression vectors. Examples of mammalian expression vectors include pCDM8 (Seed, B. *Nature* 329:840(1987)) and pMT2PC (Kaufman et al., *EMBO J.* 6:187–195 (1987)).

The expression vectors listed herein are provided by way of example only of the well-known vectors available to those of ordinary skill in the art that would be useful to express the nucleic acid molecules. The person of ordinary skill in the art would be aware of other vectors suitable for maintenance propagation or expression of the nucleic acid molecules described herein. These are found for example in Sambrook, J., Fritsh, E. F., and Maniatis, T. *Molecular Cloning: A Laboratory Manual.* 2nd, ed., *Cold Spring Harbor Laboratory*, Cold Spring Harbor Laboratory Press, Cold Spring Harbor, N.Y., 1989.

The invention also encompasses vectors in which the nucleic acid sequences described herein are cloned into the vector in reverse orientation, but operably linked to a regulatory sequence that permits transcription of antisense RNA. Thus, an antisense transcript can be produced to all, or to a portion, of the nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction, infection, lipofection, and other techniques such as those found in Sambrook, et al. (*Molecular Cloning: A Laboratory Manual.* 2nd, ed., *Cold Spring Harbor Laboratory*, Cold Spring Harbor Laboratory Press, Cold Spring Harbor, N.Y., 1989).

Host cells can contain more than one vector. Thus, different nucleotide sequences can be introduced on different vectors of the same cell. Similarly, the nucleic acid molecules can be introduced either alone or with other nucleic acid molecules that are not related to the nucleic acid molecules such as those providing trans-acting factors for expression vectors. When more than one vector is introduced into a cell, the vectors can be introduced independently, co-introduced orjoined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature proteins can be produced in bacteria, yeast, mammalian cells, and other cells under the control of the appropriate regulatory sequences, cell-free transcription and translation systems can also be used to produce these proteins using RNA derived from the DNA constructs described herein.

Where secretion of the peptide is desired, which is difficult to achieve with multi-transmembrane domain containing proteins such as kinases, appropriate secretion signals are incorporated into the vector. The signal sequence can be endogenous to the peptides or heterologous to these peptides.

Where the peptide is not secreted into the medium, which is typically the case with kinases, the protein can be isolated from the host cell by standard disruption procedures, including freeze thaw, sonication, mechanical disruption, use of lysing agents and the like. The peptide can then be recovered and purified by well-known purification methods including ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that depending upon the host cell in recombinant production of the peptides described herein, the peptides can have various glycosylation patterns, depending upon the cell, or maybe non-glycosylated as when produced in bacteria. In addition, the peptides may include an initial modified methionine in some cases as a result of a host-mediated process.

Uses of Vectors and Host Cells

The recombinant host cells expressing the peptides described herein have a variety of uses. First, the cells are useful for producing a kinase protein or peptide that can be further purified to produce desired amounts of kinase protein or fragments. Thus, host cells containing expression vectors are useful for peptide production.

Host cells are also useful for conducting cell-based assays involving the kinase protein or kinase protein fragments, such as those described above as well as other formats known in the art. Thus, a recombinant host cell expressing a native kinase protein is use full for assaying compounds that stimulate or inhibit kinase protein function.

Host cells are also useful for identifying kinase protein mutants in which these functions are affected. If the mutants naturally occur and give rise to a pathology, host cells containing the mutations are useful to assay compounds that have a desired effect on the mutant kinase protein (for example, stimulating or inhibiting function) which may not be indicated by their effect on the native kinase protein.

Genetically engineered host cells can be further used to produce non-human transgenic animals. A taansgenic animal is preferably a mammal, for example a rodent, such as a rat or mouse, in which one or more of the cells of the animal include a transgene. A transgene is exogenous DNA which is integrated into the genome of a cell from which a transgenic animal develops and which remains in the genome of the mature animal in one or more cell types or tissues of the trarsgenic animal. These animals are useful for studying the function of a kinase protein and identifying and evaluating modulators of kinase protein activity. Other examples of transgenic animals include non-human primates, sheep, dogs, cows, goats, chickens, and amphibians.

A transgenic animal can be produced by introducing nucleic acid into the male pronuclei of a fertilized oocyte, e.g., by microinjection, retroviral infection, and allowing the oocyte to develop in a pseudopregnant female foster animal. Any of the kinase protein nucleotide sequences can be introduced as a transgene into the genome of a non-human animal, such as a mouse.

Any of the regulatory or other sequences useful in expression vectors can form part of the transgenic sequence. This includes intronic sequences and polyadenylation signals, if not already included. A tissue-specific regulatory sequence (s) can be operably linked to the transgene to direct expression of the kinase protein to particular cells.

Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of fransgenic mRNA in tissues or cells of the animals. A transgenic founder animal can then be used to breed additional animals carrying the transgene. Moreover, transgenic animals carrying a trarsgene can further be bred to other transgenic animals carrying other transgenes. A transgenic animal also includes animals in which the entire animal or tissues in the animal have been produced using the homologously recombinant host cells described herein.

In another embodiment, transgenic non-human animals can be produced which contain selected systems that allow for regulated expression of the transgene. One example of such a system is the cre/oxP recombinase system of bacteriophage P1. For a description of the cre, loxP recombinase system, see, e.g., Lakso et al. *PNAS* 89:6232–6236 (1992). Another example of a recombinase system is the FLP recombinase system of S. cerevisiae (O'Gorman et al. *Science* 251:1351–1355 (1991). If a cre/loxP recombinase system is used to regulate expression of the transgene, animals containing transgenes encoding both the Cre recombinase and a selected protein is required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. *Nature* 385:810–813 (1997) and PCT International Publication Nos. WO 97/07668 and WO 97/07669. In brief, a cell, e.g., a somatic cell, from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell, e.g., the somatic cell, is isolated.

Transgenic animals containing recombinant cells that express the peptides described herein are useful to conduct the assays described herein in an in vivo context. Accordingly, the various physiological factors that are present in vivo and that could effect substrate binding, kinase protein activation, and signal transduction, may not be evident from in vitro cell-free or cell-based assays. Accordingly, it is useful to provide non-human transgenic animals to assay in vivo kinase protein function, including substrate interaction, the effect of specific mutant kinase proteins on kinase protein function and substrate interaction, and the effect of chimeric kinase proteins. It is also possible to assess the effect of null mutations, that is, mutations that substantially or completely eliminate one or more kinase protein functions.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention which are obvious to those skilled in the field of molecular biology or related fields are intended to be within the scope of the following claims.

SEQUENCE LISTING (8 sequences)

SEQ ID NO: 1 - DNA, 3136 bp, Human
gaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacgcaaaatgttctaaatgtcctccacacagtttaacatacatggaagcaacttctgtctgtcagtgtgaaaagggctatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatgcaccttccctgataggtgtggtaaggaaggactgggcatcccaaaatagcattgccctatcatggcaagcacctgctttttccaatggagccattctggactacgagatcaagtactatgagaaagaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtaatgccagagtcccctggtgaagttccggaatatcctttgcttgtcacagttggtgactggctagattctataaagatggggcaatacaagaataacttcgtggcagcagggtttacaacatttgacctgatttcaagaatgagcattgatgacattagaagaattggagtcatacttattggacaccagagacgaatagtcagtagcatacagactttacgtttacacatgatgcacatacaggagaagggatttcatgtatga

SEQ ID NO: 2 - protein, 1036 aa, Human
MGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNAKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVMPESPGEVPEYPLLVTVGDWLDSIKMGQYKNNFVAAGFTTFDLISRMSIDDIRRIGVILIGHQRRIVSSIQTLRLHMMHIQEKGFHV

SEQ ID NO: 3 - DNA, 786431 bp, Human
  misc_feature (1)...(786431): n = A,T,C or G
atgatgttggaaatactagtaacaaataaagtatcacggaaatccccacccaagcgatacggtttccttgacgcgcccttaaccaaggcgttaagtttagcctgacagcatccctccctcctttcggttcctggcctgatgagccgcctccacctgcgagcggtgcaggcatttttgttgtcgactaaccccctctagcgccgaactggcggcatccgagccgcggctgccaggccgggagaaggctgggcttggccgggctctgcagcgctccgggctccgtccctgccctgggcgcccgcctccgccgcggggcgaggtggtggagaccgcggacgccgagggtcctcccagtcagcacgccgcgttgccccggcctggggcgggggccgcggagtcccaccaagtggcccgcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaaggtaagggacggggcggaggagcgggagtgggtgggaggaggagggtgcttggagaaccagggtactggttgcctcctgcaggtaactttgtacaggggtcagagtctcctggctcgccacacgaggggatcgaggatgtccccttaccctagcgccctgtttacaccgcccgggacggtgactccacaggctaggatccgttgtgtttctaaatgtctttaaacggtagcgtgagcatcagctgcagttgggtcccaccgctagcggccgtgggaccgctccccgctgcgctgtctccactggaagtcaggctccgtggcacagacttaatggagacttctggctctttggtggtcgctcttctcaggggaacgtgtggttctcccacatgccttcttgaaaggcagggtgctcccgctgtaccccgtgaccagttatcagtctttccccacccctccggtgactgccgccctcgcccagcctcagtccccatgcttcatctaccatccaggccaccgaagtagacttactcgaaattcttcctagaccagatgctccagatctgtgtaggggtttcatattcttgcgggcagggagtagaaaagggtttagggtgaatttccaagttgtgaataccctattcatgaagtcaagtcactgacagattgcttggaggactttgtttcggtgggtaaagtggtaaagtgaaggtaaatagtggttaaaaagtgatggaaagcccttggaatatttgagcattttccctttttctattcatacaatcttcatgaaatatatctccttgtatttctgctgtgcataaagatctataaaaagtaccacctgcatattctaagtcctttcagactaagcatgaaacaaccataaaagtttcccagcatgtatctggctagatattctctcactcgtgctgtaatgaccaaccgatatgtcccttcaaatattatgtgtggtagtcagttatagttatcatttaacatataaggcatatgtttcagagtctcgaagtaatttgcaggtataaaaatggaggtcagatggcttgaaagtgttcactttttgtgtgaggagaaggttaagggagaagataaacaacacagcattcttctttgtcatcaacatatatggccattttacttagaaatgttcagaatcagaataaaatataattattaaattgttctcatttatacagtggtactttggcatattttcctaattattacagttattttaaactgacagaatgcaatcacaaatgtgtaggtgaatttggaaaccatacataaccttcatggctttgaagatagatcacataatagatatcagttacagtgtcctgttttgctgtggtggtatataccatcacactacatccctcatttattttcaaagactgtgggtataaaatattgaataggtagttaacttcatttctgtgaaggtagaagattgttaaaaaacgtgtaacgattacccttttttattatgacaaaacaatttttaataattggaaagtcagacattgatactgtactttataatagtaagtaaggatactagagatgaatactttgagagtcaagtgtactagaagtttgtaacagttgttcccatgcaataatttccccaaacaatgtttatttatttaaatacctatgatgcatcagtaactaccctaggcccaggggatactaacataaataaaacagatatctgaatctacaaatgaccctaaagtgccattctgccaaaatatgtcctgttaaagcatgacctttcagacattcatagtaaatttaaaagcatcgagatgttatttattaacctcttccagtaatttttatttgcttatctattttaatgactttctcatagtatttacagatgtttgacctagaatatatgccaaacatatgtaatttatttatttttattaattagctaaacttagtgaatgagtattatccaattttcccatcagttaaatagaagcattaaagattgtctacttaaactcttaatttgaatttgtattgatataccgataacacaggctgtgcataagagtacagtgggcaaaatagtacctgaaggttaaattggataaaatttaggtgacttcttcaaaagaacattataatcagaatttttatcagacacaaattattacttataaaatgatgctttttacagcctaaagtcatagtgagtagaaatttttcctgataataagttgagataactttcaaatattgaaatcatcacactaatggttaataaaatgctaggtttctaaatgttattcttaataacattttagggatattttccttactcgtagtttcataatggataaaataaagcatctatttttaaacatggaaaatgggacattatagaattatcatatgtattcaacatggaaagataaatgtaaaatataaatttgatttattatacacataaaaataaacagtaatataattcatatttagtattgagaagatagttttaattgtccaataattttcactttaaaggctaatggaattaatgttttaattttgaaatttgttattttatagagggtaaaattacatttatatgtaacttcttcctgattaaagatattcacaaaataaaattttaatgttatatatctgttttaccaaattatatgacatccttcatggctgaaaagaatggattcacctttcccacaacccccaccccaatccccatttttccatacataagcaaggtaaaatgatgatgataatgacaaaaaagtaaactacctcattcttttaacgtggtgcaaacagtaacttgactatagaaaggatctcttctcttgtcttttaactgagtgtgaagctgactgtaaagatgaaataaatcaatttgactctctcttcctatgaaccaaacctccttgaatcgatcagaaagtaaaggttcttcctagatcacttcatctgattaagtaagtggaaacatgaattgtgtttaaatctctctcatagtcaattaattttccctgtatttaaaaccacagtattaattaagtgttggaaatttttattttaaaaacatttcatcttttcaaggaatatagcctttcatttctgtactatacacttatatgaatataaaacacaatcttgcttcatgtataagttaaccatttaccgtgtatcacagtggccagtagacaccagggatccattcattcaaagattattctgcagcaaatactactttatagcctaaatgagttgatgcatatctaagggtgtggctcatgcttttacaaataatcaattgcatactcaaataattcaattaagtcaaagtatggtatgggtaagttagtctagtgaacttattttattagcaatactttgtgaatcgattttccccccaggcaattcagtgacaaacaaaataagcaaaacaatagtgtggctggttgatttcattaaatttattaatttgagcgaatcaactgcataatccactgagttgtatataaatacaaataaatatatctaagcagaaaaacatctgcttaacaaaattcatggcctaaaattagttttatccatatgttttattcacaaactctgattgaatattgttcttatatttatagaaatggagacattgaggaaatttttaaagatttttcaaaagtaaacattaaaatgctgaaaatattaaaaattttgttaaattaggaacactggattacttagaatgtttctgaaagaccattcatttagaagaaattagtttttgaggataaactatttatagttgtaagggttccagagattgttatcacatcacttcttgttagacataagtataaatacaacttagaatataattttattatacatttacaatataaaataagtaattgtataattagtcattattgattagcatccaaagtacaaagataaaatgtttttatgcagttccagcagtgatcatctaattgttgtttgttctggtcttgggataatactatatctaaaagaaaatttcttgcacaaaaattatacataatccttaaggaactcttcttcaaacaaaaaataacttaaatgaatatagttgaagttaatttagtattcatgactatagcacttttatatgaatttcctaagggaaaagtatatatctattggtacaggggaaattaatgattaaattacatccttttacttttttgttacttttacatcacaaaataagtattaaaaaatattagagtagaaagccttttgcttctttgtttcttcactaatcattgttagtataaatgacttaagtacaaaagatataaatttccctctaccaaccctttttccctatcacaatttcagtaactctctctctttctctctcccacctcacatacacaaatgcttctgactgcatgctccatttgttctaaatggtgaaagaatagatcccacttcacactgttcatcaaccaaatcccaacagtaatagaaattttttcattgtacccttgactcaccattttgggtttacaaacatgctggaaatcaatatatatagttaggtgatcaaaatagtttgactttgtccaacatacattgtaatcaaactaatttaatacaggatcaaattgcgtatctctacagtgttctgttcaacttgtaatttaatcagactgacatttaaacaaactgaagatacattctgttcttgcattattttattgagtattgtgttttgtaaactaaaatttggattatggatttaaaaagaaagataaggcatgtgaactcatgatatttgggtaagtaaataaaacaataaagattgtaaaaattatatatggatgaagcaacaaagacactgagaaagtaacaggagagatgtgctatttgaaatgggacagttggaaagacttgtctttgaaggtgacattgaaacctcattctcagggaagagaaagagctcattctgcagagtgggaagaagtgcgtaacatatagtggaaactgactgagcaagggtctcgaagagaaatgagcttgacacatttgaaaaactgagtccagggtggactggaacttactttgcaaggaagagagttgcagaaagtgaagtctgaaagatagtcgggaaccagagtcctcagagtagaataagattcatgttaagaaactgaatttttatattatcctagataaagcatgaatctatagggaggttttgaccagttgagtaaaataaaccaatttacattttagtagcaccatgactagtgagcaaaaacttaattgggagatgacaagagtagaattgggagtcagttgcagttgtccgggcaagatgtatggtggcctggcatagagtgatgtcggtggagctggagagaagaagatgggtttgaaatatgttttgtaaatagaatttatgggaacatcttgtctttatagaaaaataaatgcaagaagcccagattaatttttcattattcttcattgaaattaccttactaaatattgataattgcaagggataaggaagatggagtagaacaaaaatatgtagcaaggctgagatgtgtattttccacttgattcagttcaaacaataatttaaaatataattttaatagaacagttttgttatttcaaaccattgtacataaggtaaactcatttggatcaacaaatgcaatttgattcatttctgacatggtaactttttatatgtagttattttttgtcagcgaacgactgtacaagtatgtagggacatcttcatatggcaacatagtaagccagcagagtctaggttttggctaataaggagcaatatttgaggatttgacatatgtaccagttttattcatctctattatgatcaaattactgttattgaaaacacaaattctaagtgatactagatataaaataatgtgttttcagatactttcaattatacttatctgttctgtttaaatgaagaaatgttcagcaagacctagaaaatgagatttcaggatatgtgatatttttggggatggagtgagggaagaaactgttatacttttaagtaaacaacggtaaattttatgcaattaaaaattttatatgaccagtcaattactgattattttgagttaccttttaatactactacatgaaaataattattaaatgtagagaacataaaaattcttaacactcttacacactgttttttagaaaattcatattctggagatacttcatttaaatgtttctaaatgtatttaaacatatatccaaatgcagtaaatcttacattttactttagtgctttagaatgttctggaaaatactatttttatagttatttcatttaaataaactatataacttcttatgggctatacagtttcagttttcaattataaattctctaaaacaaaatgattatttaagcagatatttattgcctgctatatgactaggcagtgtatttgccatacataaaggttcaaagagaacttttttctcccagaatatatgatccagtaaagagtttacagtctgtttccagatctgataggaaaaatttgttttctcaaaatcaaattaataatcaagtataaaagctttaaaaatgtatttgttatatgacagtgtataccaattaaccccaataaagaagatttatgtaaagatttatttaaaaatatctattattttattacattttattttaaagttaagataataagtcactcagcaaccatagatttaatatcaggcattatgctaagtattgaggttacaaaaagattatcttcatattctgttctcttgaatctcagtttgcttactggcattttatattttgagtaattgatatttatttttcaattacttggtggtttctataagatgaagaattttacagtaaatgatgttgcatggaagaaagggaagagagtaaagaattgctgtgtaccatatgtgttttatttgtaaattgcttcacaagactcttctgatgttagttgtatggattggcagatattctacttaattacataaaaatgtataaatatgcattttacaaacatgttcatatgtacaaaaaataaatatttcacacatttaatgacatcgtggatggatgtgtgagttgagcttttgttcaaaatatgttagactggcctattctggtgtgcttatttttggtgggttagttattaaaaactaattcatgttgaagatgctaagtttccaatttcaaatcgtagcaattgtatgttttaactgagctttgtgagaattgggatgaaagtgtgtattttcactccagttcctgaaaaatatattgagctagtttcccgggattctgagtcctccagcttttggcctatttggtgacctgtgcttgatagatgtaattgacaactcattatgcttcctgctattttacttcgtaacttcaaatgtaaaagacgtactttttgatcagaggaaatatgaaataacattgccttagaaaatggttgttaaggagatagaaatatttaatttattattttactcttgtaatgttaggtatctatgtggatatctggataaaaagtaagatactttatatataatttaaaagtatattttaaataattttatatataatttattatgttaattcactaataacagtaaattatgtgttctttcaggtgactgtactataatatacttgtattttgagctacatgagtgttgcaaagagaatcacattcttaggtagtgtatagagtataacacctagaaataggaaaagcactaacttttaatgttaaaaaagatccataactttttaaaaagtatagaaacttgcctacttgtggtaattatatttagatgtatttaaagcaagttaataaagataaatgttgtgtactaggaaataaaaaagtttcattaatatatattctaagtaagaattatctaagaaaaattgatatgattgcccccaaatttgagtggaattagtcttggtagcaccttaatttttatttttaaagagaggcatagtgttccatatgttgatataaaatgacactaatattgcaaaacataattgaaattaaatgagtaaatagagaatttaagtatgtagaggccaataaattagttattctgagaattgatatctcacacaagtaaaattgatttttaaatacaatgcagtagctaagtagctataaacataccaatgattaaagaaaaacagagtcaggagaaaagctgatccatggcagtattgtttaaatgattctatttgttaaggattctctctggctgtatatattcaaccatactctggcctaggtcccttgatttattccagtatataagtgtccattgctgacaaacaatcttagctaaaactttttttaatattaaaaatctcttcttttctttctcttgagttaaagcatacttaaatagtatttatcttgtgaaggcaagtgaaaataattagtagttgccatgaagtgtgataagaaatagtcgagcagcagattccattgtacaaagtcataaaagaattgtatcaatttttgaaataaaatgaatcctatgtattggtccactgctagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttaataatttattttaaggttagtaatctaaagttttaataggtttattaaagctaaatggtatatatatattttaaatgctaccaagccttaaaatcagataaaattttaaacatatttctattgtaaatttctcaaatattttgtcattgcaatatatctgtagttatctttgggtttttaaagtttattcattttaatttttttccttttatataaacatttaggttcttaatctcataggttttatatataatatacattttttctggaattctcaaactagttctgcaataagcaaatattcatccaatttttaaatgaaatattttgacacctattatgtttggtgtgttgagaaacaggaaacacaaaggcaggccactgccccaacttgtgagagcttacagtttagctaatgacatcagtaaataattaaaacaatttttaaatatcaaagttacatgtattcagctgtacagttggtaagttaccatctacaaactattgtttacagaaatgaaaagtactgttcttaaggatataggaattaatatacagagacgttgagaataaatattcatttagtatattggtcatgaccatatgttagccacgatttgtgtgactccttaaaatgaaataagatctgccagctcccccgcccctgccctcccgcaaaggacagtgttataaaattgaagaggtatagctgaaattaaaatacaatataagatggataaaatgaagagaaatgatataaactttacatacaaataagcctgagaacttgagaagcttgagttatacatgggaaatgaaaatgagtctcacatttatcaggatttatcatcatgaatatatgaaaataattagagaattaagatgaatgactactccagagacctccattttaaagtaactgaattagtttttatgcgtttaaagattaaaacttatgcatttaaggataaaaaattaatatccaagtgaataatgttagattgagcatagaacttttaaataagtgatgtgacttggctttttttttaaagctttatcttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacataaaattgacagtacatgtatggtttacgatatatccaatttaaaatatttcttcaaatacctatagttacttgtcatcccctatcatgttaaatatttttattgttattttctctttcctaactgtattaaatatttgtttttagtagtattgcagaactttggaattgctggtgttctttaatatttatctttagaaattaggtaaattgctgtttgatagagcctttatttttatatttgagaagcacatagaattagaaattgctgccagaacttggtgtttttaaacagagaaaaatcaatagcagattacccgtgattagctgttgacatttagatttgtacttttagaatgtcaaaaggcagtgaaaactatcaatctagtttctgtattataattatactctatttttaaattaaacattttatggtccttcttcccatatatgtgatatagccttttggaaaaaattaattataataattaaagatattttggtaaaaatgatgacctttaataattatttagtcaaaaattagaggtctactgataacgctaatagattatccctcactttgaatacatctaggtttttttgttataattgcaacaccctattgcaggcatcatttttaaattgtgaaaataaatatttttataaggttagattaatatatttcttctataatctttatacagtatctagcatatagttatttattgctgtcataaaagttattttaattctatgccagattatatatcataagtctttgatgtgttttctctgatagtagattatttacttaggctgtcagaatctgacttataaccagactttactgaattggacatattttcaaagttttgataccttaattctaaaacattttagatagactgtactacacacataagacacttgtgatatagatcccattttttcaaatgcatctctagcttgggtggaaattccactctagatatggcactagaatattaagaggcttaaatggtacctgtaaaactaagggaaaaccaccagtttcctctttagtatattagtaaatgatttatttactctccaagtctaagattatcctgttcagtgcagtttctctcaacttctggtttaaaatatgaacttgctctattccagtgctaaggtaggggatattttatgtgcattggctattttccatgtctttctattagctgttcttaaattggaaagattgtggtttatgcttttatgtctaagttctttatatagtccttatatatctcacgttatttccaaatatttttcccaagctgtcttttaattgtgtttattacagtttcaaaaacaaaatttgcttcagccctcaagttttttcacttttcttttccttttgagatttgcttctgaagactcatgcacacattggtcggtaggcaattgtgaaataaaatacccatttaccaacagctgaataagtacttcatatactagtgataagctccttgataataggtcagttgtacaattatgactaatggaacttattcctaagtggggttccttatcttccaatttaaaacggcctaaattcagtcacctaatatacatatgaagaagagtgtttgacacctacctgggtgtagtttgatgccagagagtggggaaggtaaagtcaggcttaggaggagcatttacatggatggaggctgacacaaaagaatgggcatctggctttactgcatgtgtgcactgatcctaaagcctcacacacgttatagtcttctcatttgtccagctctgagaaagtttttcttgagtgggaaaagctagaaagcagttgaaagaaagttgagaagttgagtaagaactgggatgactctccatgtgaaagcaaagaagttttcttttccagccctcattccttaacattgaatatttttggaggagtttatgatttttatggaacaatgtgtattattcttttttgttaattttttgagttaaaaaaatgtgtagagaacacttgcccatcctatttaacttcattttctagatatgttatggcttcaggttaatatatcatgcctcagaggatgttatgatggcaagtatttcttctgaagatatgaagtgtgctagaaagcaattaaacagaatagtgaaaactgttcatatactcggatcaattaattccacttttatgaatttaaattcaagacaaatgacaaggaaaaggcaggccaataattatatccaaggattttcatctcagccttatttataaaatgggagaattggaatcaaatgtcccgaaataggaaaatatttttacagagataactttctttatttgaaaaaaagattcttcaacaagggcatgtgcatcaacaggggtcccaaattcctttgcatgaattaaatggatagacttgtttggctgctaagagagaatataagagaattgacagaagaataaggaaagaaggcttgcaagaacagtctaatggagattcaggggttgctttagagtggctaagaagacagttaaaaattcgtgattattgttctatttcgggttgtctttgtggctaggatgttaactccctcttcatcccaacatctttactttgaaactttcgccagtctgttatactctggaaaaataagcatatagaagagagaaataaaagttctctgagaaaagaaaatcagttgcccccatccctgcaaaaagaaaaaagaaaaaaagatctcctaaacatatcagagtttagttaattggggttctactaaacttttgccctatccttttaggctgttcagaacagcagctgggtcaggaattttattcccatctgatactaaaatgagttcctaattccttcagaggagataacgtggacctatctaacatgacagcattcccacagaatttacaaagagcaaaggaatgaaagaaaatttaaaaaactacctatgtgtccacgatgtgtgctctttctcttatcaggaaactcatgtcaagagtatgagaggtggtgtttagagatggaaaagaaatcttaaagtaaccttaaggatatggaatccactttcatatgctttagacacaccagctccacctttgtttttatgagtgcttaggaatggcttgtccacctgtcctttgttcctggaaataaaccccggaatcagatattcgaccatggtttctggccagattaaaatggggaagtattttagcaaaagtgaaagagataggctgtgtctttctccatctccattttcctggatgatcaacactgttccattcccaacacctccacagctccatcattctgagcttcctaatacgttttggtggttttgcacagccaccagtctagactgtccttgctgcctgatatccagccaagagctgactacacatcctcttgatttttagcaaccagataattaattttatcacatgctgttactgacaaatgaatttccatttttgaatggcaatacttgcagatctagagataatgtaaaaataatgacttatacaaagttggggtgcctagggtcaggaacaagatttctacatatggactaagttccagactcatatttattgactttgttttggaggttggaagctgtctcagcccaactttataatggttgtgaaagggcacactgaggtatgaagaacaagcacttcatactttatcttagactgataaagatcatctgtttatcaagaacttttgcttaaaatatatgaaagttcctttttaaaaagaaatttgatgggagtagaggagaatcattcgttttatgtttggaaacttaaaagggaaaaaaattaccccacatagtccagaaggtaaggagtacagttaaatacataatcatctcattttacagatgaggaaactgaagcctagggagaataaataattactgtggggtcacataaccagaagcagacccaggatttgaactccagacagtttagttcctgtcaaaaaatatgtgctctccctcactacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgaagactgaaattctgtattaaatgctgatgagtatcttattaatacataggaaatggaaatatattgagttactgaattttgcttaaaatttcaaaatagcttacctagctattactgtagttcttataaactttcaggcagttgtttatatgctgagctaatactgtctgtatacacatgcacgtgcatgtgcgcgcgcgcgcacacacacacacacacacacacacacacacacacagaaatggtatgctatttgctccataaacttaagttctttttcactagagtgcagtggttcacataatcctaagtatcgcattttagtgctataatgaaaagaactataaatttaaagtatgtgtacatttttattttttctactataattcaggtcatattacattaagtattctgaatataacttgcttgagactgtagttattaggaatatcaattctaatttaggttcaaaacaaatggataacatcaggtctttgtgcttacagaggatatttccctgaaaaactcgaacatgttttatattcagtagtctttctcactaatgcgcatataaaaatgtatctccagttgatggaggatttgacataccagaaaaaaagaaaataccaaatacttttcaactgtgtatattaattctaccactttttcatttttattccacctctctaaggtaagtaagtagcataaattactgtacttattttactaatggaatttatatggacgttaagttacttggcaaagctgatagggcaaattggtaaccacaaaggaaaaagaaagcagattttaagcctgtttgatccatgtactttctattaacaaatgggaaagagaatttcaggaaaacttctagaatattaaaatgtaaatatattacatttaaatattatttatctttaagtcttgaaaatatgtaagcacattgaatctatatcttttataaataatctgttttaaaaataatagaaagattatttggagaacaattcttaggggtaaggggaaatgggggggacattgatcacagggtatatagttacagttagacaagtaaagaaagttcaagagatctgctgtacagcatggtgagcatagttaatgataataaagtagatgttaagtgttctcactgcacaagtgataactatggaaggtaatgcatttgttaattagctacatttaaccattccattttatatgtatatatatacacacacacacatatatgcttcaaaaaataatgttgtacatgataaatacaattttatttgctgatttaagaaaaataattgctttccctgtattttatattccttcgatatttttaaaatcagaagctaatagttatgattttaagtaatattgtcatttttactctcattttatttatgtatattatttttgtgggtataaaaccatttactatgtgattttgcttcttcatttatcacctgtttattaatttgtcctgtatgtttaaactgtgtgctaaacaccatataagctgtcttgattaatgagcagtaatgaaaacttaagtacctactgagaagccacacagtttgagtcatcagcccctgatcctcctccacgtgggctacttttgattttcttccaattcgcatctattacagcacctgtcaagtcttagtgtctgtaagaattgttgcagaacttgttctgctgagcccactccaatgagttggatttagtgtctatgagacagtgtttgtgattgttcatttttttttttgccaattgacacttttattaagaataaagatgatccattcctgtattttattattattattatagtttaagttctaggatacatgtgcacaatatgcaggcttgtcacataggtatattcatttttaataggcattcttatatgatttatttgcaggtggtttgagaaaccctgacttggacatccttatctgtatcattcaagttctttgcaagcaataggaattgaagctagctaacataaacagaaaataaattacttataagatattagatagtccacagaattgaagaatatcttagaaaacaactttagaaaatgattgccatcaaccagtgcaacacctggaatgtaggcatccggaattattcatcagtccccttgggtttaattgatttcaactctgcttcttctccttgtataactcagctgaaaactctcaatgctgcaagaggaaatctgattggccttgagtgggtcaagcccctgcatcatagaaagggtagagtctttttattgacaaccttaccatgactcgacgctatgtgggaaaagtaattccttaaaaatgctgtcactaaaacaagtggaatgggtaatggatggccaaaactcagcgtatatctaatcacttcactgctcatgtaattatcgaaataacttctttcagattttagcccttattttaaaaactcgatttagaagtgaatatgactttatctaactaagagtctatagagtttaacagttcagcctaggatggttaggtgtaattttactactaccatcgatagaatattaacaatatagaatgcatattataataaaatcatgaagctaaagtcccaatagaatagcatatattttcttttccccaagtgtaatttgtaacatcctttgtcctgataaaactcttattctgcagtatagacagtaaggaaatatgtaggtggcctgaacttctaacctttcttgtaaaagaaatttgacttttagcaaatggcttatgctaaatccacaatttcagtacattcaaaatactgtataatattttggttattgccattggcctggttaaaagagaaaacttgtgccacacaatattgtgcccaatattggtttggcttccatacacaattattatgcttttaaaaataaattgattcttaaactctgtaacaaaatcaatatacttctaagtctaatattttttaaataaccagtaactgacattttaagcaacttggattttaagactgccaatgtttcatctaagaaaaatttaaggagaaaattacttttccatgggctaccttcccacatgcagtagtataaactatgagtttttgagtgcttactctttgttggatactataccaagtagtttagtatatttatgtaatcctcacaaccctttaaagttatattatcattattatattcattttagaggtgtgaaaattggaacacagaataagtaacttggcccagtgttaaagattattagttacagtatcttctgcgttgaattatgtcctctcaaaattcgtatgttgaagccttaactcctagtgcctcagaatgtgaccttctttgtaaatagtgttattgcagatgtacatggttaagatgaggtcttactgttttagggtggacccctaatctagtatgactggtgtctttataaaaggggaaatttgttcacagacatgtacacaagtggaatgacctgtgaagatgaagacaggtattggtgttatgcatttacaagctaaggaatacacaaattgccagaaagccacacaaaaaactaggaaggaggcatggaatggattctccctcatagccttcagaagaaactaactctgtgaaacctcagcctcagacttctcacctttagaactgtaagacaataaatgtctgtgttctgtgtcacccagtttgtggtactttgccatagcagctctagcaaactagtttacagagtaaggatttatagctaggcattgtggctccaaagcttgcattcttaaggagtaaactatggtgtctgtgtaatggtaagagatggagtggatatatcatctcttagaatataaaagagatctagctgaagaaagttaaaccagagtaagagagctaataacattttcctgaagcttgaagtgcctcattgtaagagtgttgtgtgagaaaggagcctaaggtactgctttccttcaaaactaactgcatttatcattttgttgcattaagaacattgcaattccactgttagttattttaaaatatgcaataagttattgttaactgtagtcatcctattgtgctacaaattactagaccttattcattccaattcataaatatatacaagtattatgtacccctaataaaattaaaaattaaaaaaatttcccaaagctaactgacaacaacaaaagaaacagtaataactatgactaaatatgcttggaaaaataatctaagattttaactatcaattatacatttgtataaattaatctgagttgatttaaatgtcaaaaaaagcatctcccttgataaatttctggaggaagactaaaagaaaaccataaggaagatcttggtagctcctttgtggatgatgaccatttacatatacctcagtttacagagtatgtaacgtttgcataaacccagactttgagtaccagtgcattacacaggaaaaaatgaaagaaaaatgtgattctcaatgcatagtgaccataatggggaatctgcatggtctgcccatgccttttctcattaaaataggtagctggagaattaaggaaaagtcatgtgtaacctaggttttcctgttaaaaaagaagaatggaataaaaggcaaaaagtgaaagaagaattagaagtaagtaggaagtattttgaaggtgtattgataccacagctctgaaatattagcagtaatgaaaagctcaagacgtcggagttgctctgaattgctaagggtggatagataaaagcctggaagccctgttgttgttttttttccttccaactctaagaagtgattaaaaatgagttaaggggagttttctgggattcaatagaggagatggtgatttttaaagcagagatagcttactgttaaagtttggtcagtaaggtacttgatttgtgtctccttatatttttctttaattttttactcattcaaagctgcataatcaaataggtctggaactgaatatcagttccatcccttattaacaatgaatttattggaaaatggcgtaatatctaggctttcctttaattatctatcgaatagcaaaaaagacactatttttgttttgaagatttatagatggggtttatgagcaggtgtccggccatacaacaattataataataatggtgtaatacccaaccttaatcaaattattaccatgttttaagcaatttagtctttatttcattcagtcatcacatctgaactaagaaatagttcatgttaattcaacaacacttcaaaaactgacataatgagtttgagtaatttgctcaaggtcaaaagatagtaagttgtagatttggaaatcaaacctagttccctacctttggaattcacgaacacaatcagcatttattaaatatataactattggccctgcattggagatacaaatatgagtaaatttagtcttagtcgtctgtgaatttactgtttaatacaaagagacagttgaatgtgtagagaaaagtgttatagatgtggtgatgaaagtatgtacagcttatcaaaggcttcaaaggaagtggtggtcacatctactttcaagtttcaagaaagactttgtataggacgtgaagcttgagatacaggttgaaacatgagtgggtgctcatcagataattagtagtacaaatcattccaggcagagggagtatcaagtgcaaggggatggaaaattcatatggggcagggtgagaggtgactggcaaatagttgggaatagataaagactgtgaggggtaatgaggcaaataatgaaggaaaatacacatgcatcgttgaggataagaagagccttgaatgctatgctaagtggtttttgctttatcaagaagccaaaagttcttgaccccggctgcatatcaaaatcattatagggatttttgaaaaaacacccatatttgagtcccacccagatttatctctgtaaacaagacttgcaatgaattttggatacctttcttcttactcttgtgaagactcttaattattaagtatgtagtagacccacataagtattgtttatttccttaacaaatgtggtggaatgaatctcgtcatttctgaatggagatgcatagtaaactttggcaagaaaaattatgcaaaaatattgccaagaatgtcacagtattaaggggaaataagcatcaatgatgattatttttcacattacttgtataaaattcatcttaggttctatttggtttatgtaggaagaaactctgaaatataatctagagataatacttggctactacatgaggtatgcagcacttgacaagtagctttcatctctgtgaattttttcataaacagtattctcttttctccttccttcaaatcacaaaatcacttttcttggcatcatactagtgcatgaataactatctggcaaaattatttagtccattaatatttaacctgaagtttgctaatttattgctaccatggggaaacatatgaagaagcttaaaaaataataacctttttcctaggttggcaccagacagattaactaggttggctaacactggtctttttgtggccttgggcagatattttaatctctttcagtcacagtttcctccttggtaaagtgctgataatccttgaaggttctattttacaaggttgttgtagcaatggaatactgtttgtcaaaacgttttgaaaattgtgaagtgttcaacaattgtattctttcacatactgttttacagcaatgctgacatctgtaaacattgccaatcaagtcatttaatcattcattccacatttactgaacaaacattaattgaattccaaaaactgtgattcatgttggcattaaacagatgagccgttctacctcccttttgagtcaaaaagaagagaacagtaaaaggaagggcagataagccagttgtatccaagtgtcaccattattgtgcctgtgcacacttcagtcctgcagcagcatctgacagtgcaccttattctgtgctgccaacacacatagtcttgtcttgggttattagattgaaatagggcaaaaaggggaaagtaagtctaccattctgcatagataaacacacttaatcctcctttcaccccctatgaggtagataccattattattcccctttttataaatcagcaaagtgagacacccagagattaagtaacttacccgaaaacactcagataggatgagaacttaaaaagaaaatggcactatgtgagggcatctagactgagtgataagatagggaggccaagaggaattccttgatacaaaggtcaggaggtggaggtgacttttcatattggctattgtagagcaaatagaagtgtgccctgcattctcaagttatatcctagaaacagatggacatagcttctgtaactgaaaagcttagatgtcacgagcacagagtacagaaatacataaactagttatcataattctgtgtggtaattgctctctggtagtaatgtgcacaggatttcctgggagatgaggaagtgtggtgtgacttactctgcatagaggggtcagcaaggcttctcacaggacataatgtttgttcagagtattgaacaacattgtttatgatgagggagaatcagcagtaaagggcatttttaaaacatgggagagatcattcaaagacaaggaacgaattttgtatgtctatgaaagtgcaactaatttggtacaggtgtcatttagagggccaggacagattggagacaggggagcaattgaaaaatgaggcagtcctaaactgtttaccaggtcaacatgtttcaataatatcttacttttggaccattttcagtacgatgtctttaatacctttaaataatagctcatttaatcatttttggtgtattatgacaactttaggcagagacattttgattatattattaatacgtataacaaaatcaaaattaaaacaaaatataaggcagtatttcatctttttatttgagaattaatgcatactttaaagaataatctttcaagttttttttaacttaatgtatcttggagttttttatttaaatttccaaattttactttaagttcaagggtaaatatgcaggatgtgcaggtttgttacacaggtaaacatgtaccatggtgttttgcttcacagatcatcccatcacccaggtgttaagcccagcatccattagctattcttcctagtcctttacctccttccacctatggccctccgacaggccccagtgtgtgttgttctgcgcccccctgccccccacccaatgtgtccatatgtttacatcattcagctcccacttataagtgagagcatgcagtgttggactttcttttcctgtgtttgtttgctgaggataatggtttcctcctccatccatgtccatgcaaagtacattatctccttcctttttatggttgcatagtattccatggtgtatatgtgcaacattttctttatccagtctatcattgatggacatttaggttgattccctgtctttgccattgtgaatagtgcttcagtgaacgtacacaggcatgtgtctttataatagaatgatttatattcctttgggcatttacccagtaatgggattgctgggttgaatagtatttctgcctctaggtgtttgaggaatcaccacattgtcttccagaatggttgaactaatttactttcccaccaacagtgtaaaagtgtttctttttctctataacatcagcagcatctgtgttttttgactttttagtggtacccagaataattataattttctataattcaaatgtatattttaatatatcaattaaaaggtctctgcttaatatgacataaaaacttcttagtatttcaatatttgaaatttaacaaatttgcactaaaattcttagtggttcatttatacagtgatcataccctagttctaaataacaacataaagaagaggtcacactgcagtttcaagtacttatatgtgaatggtacattttgtgttgaaagcccctcccccaataaatataatgtttactatattttatatttttattgtagctctacatcagtatttttcatgcttttcactttaactagtggtcatttcttggtagatatttaatactatgtgacttagaatgaacagttttacctagcaagtggttcccagctgagaaagaggctacactgacattagtctgtatctttatggcttccattttaaagcaaaactatttgagtttttatgtagtgatttaaaaactataaattggaaatccaaaggtaaaagtttttttatttgtacatttaaacttagtatcccctacagcagaggtccccagccctgggctgcagactggtactagttcatggctttctaggaaccgggctgcatagcaggaggtgagcattgggcaagcaagcattaccgcctagtgtcacctcccgttagatcagtggtggcactagattctcataggagcgtgaaccctattgtgaactacacatgtgagggatctaggttgtgtgctccgtatgagaatccaactaatgcctgatgatctgaggtggaacagtttcatcctggaaccattcccctgcttccagccccacatctgtcatccatgggaaaattgtcttccatgaaactggtccctggtgccaaaaagtttgaggaccgctgccctaaagacctaagggttttggaagactttagttgggaactattattgtagttgattacaacccattaataggtattaagaaatgagaaataatattaatattaataagaattaatattttagaatgcttaccctggaaatgaggaatgctatggagactagagtcagaggtgttagttaaaaaatagttatgatagactaggaatgtgaaaaaaagatttctgagaaaccttataagctttcttaaaatttggtagtttggtccttattgttgggcaggttgttgatgttgtagatacttactaggcatttgttagcacagcagtaaatctattatattattagtatgttttaggggaaggatgattaagtaatccagttaaaaaaataataattctggccccaggatgaatggtggttagagagggcaggaattggtaatgggagaccatttagaacactattgttattgttcagggaagaaattattgcaatttagactagagtagtgccaaagagtattgaaagagttgatggatttcagaggaacatgtgctggctgataagtgctccagttcacaggtaatgagtgacacttagctcacaactcactggctacagctaataatatgtctggtcccaatcatcagggcccaagaagtgcagttgtaccatgtacctgaaagttggagattttgtgaacaataatagtgattttctcagtttgctcttctggtaaccagatacccaactaattctgccttttgttggcaaaatatatacacctcttgggggtggatttgggatatctgttatttatctgtaatcttgatttactcagaattatttatttttctcttgactcttgatttctatgaagtcaagagagatttcacacaggtgccgttgttttcatctttattggctcagcaagtctgtcagtagtccaaaccactctcacaggaagtttaaaatgccttcgttattctggaccttgggcctgtagtcgtgagcaagagtgatagcagcagttttagagatctgagcaaaagatgaggagatgaatgacttgctgtctgaccactacctatgtataggatgtcagtgtgatttctctgcctaactcagagctgacacactgggtgaaggtacaattctggagtgggcaagaacactgccaattcaaaccaaagaaagtactgagtcctgattaccggccggtgtcttgaggtgggacagaaatctgaatttagtaaagttgagtcattacagtgactgcttagagaaaaaagatggagatgtacttccctttggccttactgtggcaatggagttgacaaaactgaatttaaaaaaatctattcatttttgttttaaagtttcaagggaacctaccagagctttaaaagtaaaaacaaaaattatggtagtaattaatattgttttgtgaacccccaaaatctgagacaggtctcagttaattttgccaaggttgaggacatgtgcccgtgatagtctcaggaggtcccgatgatgtgtgcccaaggtggtaggcgaacgtttggttttatacattccaaggagatgtgagacatcaatcaatatgtgtaagatgtacattggctcagtccagaaaggtggaacaactcgaggtgaaggctggtcaacttgaagtggagaggggacttccaggtaataggtagaaagagacaaatggttgtactcttttaagtttctgattaacctttccaaatgaggcaatcagatatgcatttatctcagtgcattagaggggtgactttgaacagaatgcgggcgggtttgccctaagcagtttcccgcttgacttctccctttaacttagtggtattggggccccatgattaattttcctttcacagtttgtataagctttccatctttcgatttccaaacacgtgttaggatcaaattttctagccggctttgtggttgggaaaggccatgtgactagtttgtccaatgaatgtagatcagaagaaatgggtgtgttacattaagtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagctgggtgtgttagtgtgcctgtaatcctagctacttgagagactgaagcaagagaatttcttgaacccaggcagatggaggttatagtgggctgagatctcaccactgcaccccagcttgggtcacagagtgagactccgtctatttaaaaaaaattaaatcttcatattttaaacgtttatttgaaaatttgattatatactttgctataaaatgctaaataatttaggagtgttttggaatcctttgagacagggtaaatgtgtcatgtttatatgcttaaaaaataagatgtttttcattccagactagagtttactcattttccttattcttaggtcatctgaatagctttatgcttatattttgtataaaattttctgaggtttgtaatcctgtttaaacacatatgaaaacatcgaggttcagtcatacaaaattacagtcatagatgtaatttggctttttggtctatgtaacttaacacagtaactgctttttttccagtacaatttgaaaaaagtggaaatttcctaggggaaaatatatgcttatcaaaagttagagctgtcttctggagcagccttcaaagctgaagtaaataagacatgaagtttagcttccaagcaggctttaatttagaaattgctgaccaaataaaaatgtccatagccttttgtcataaggtttgttgattactttggtccagttgagctgattaggtcttaaatattataaaactcaaaggtaatagcataaaaagtgccagtttaaatattttattgatcagtagtaatgtggatgattctgacttggtatttattcattaacactgtgggagtttgggcagtaagatgggactcttataaaatcaatttaatttaaaatcaagttttacagtattttatttctagaattctaaataaatatatagagaattatttttgggctttgtgtcaggaaaacttccatataacgtcatgttaacttttaagtcttgctgtgttaattttttatagttgcttggtagaatccttcagtgggaaaccaggagaatgcaggatcccttcaaaatgtcaaatcttagaaattacttttctttcactcttctagcactataagctgctcttatttctcttattcttaaactttcctattcttttgtcattcacaagatcagagaggccttaggcatagtggttaggaacttgggctttaaggcccagctggctggacttaaatttaaatggtcctgcctctcactagctgtgctgactggaggttctttacctcttcaggactttgatttctcaactggtaaggtgggatttgtaataaggccgttaaaaaaataaatttgaaataaataataaatgaggtaatgcacttagagcatgcttagcagagtgcctgacatacaggaatcattcaagaattgccagctaaaataattatattacgttacaggattttagaatgagattcataaactgagatgaaattccaagctcaagaacaatatatgggtgccagtacttacaaattttaaagtgagtcactagactgttcctgtatagctcatagttaaaagtttttaaaaacctatctttccagcattagagatgtccagtttcaactattgtaagtgatttattttggggagattggaaggagctgtggtttggagtggagaagggctactttagtgcaggggacattaaggggatgaattcagagtttaattcatgtttgctgtaatttggggagcatgaggatgtgagagtttgtagctaggtggcctgagacaggagagcagagtcagaagctggactgcaccaggagatagcccaataattagcgcttaggggtcggaggtacatatttcatcgcctggaagtgcgccatgaagaaaggaactgtcctagaagcctttagaaagggtactgtctcaaatgctcagatggcttcctggtggcatgatgtgatcttaagacgtgaggaagaagttgaaaatgactaattggaagaggcacaaaactggaattttccagcagaattttcttaaggtggtcacgtaagagagagtcagctttgaccatcttccagttcacccatctcactggcttgactttggtgagtggcagattatgaacagaatctgaagacatattctttcacactgcaaggtttcaggttttaagcaaaagcaaattagtggagaaaagaacagagttgtatgaatttagaattttgttttattctagagctaaatagtctaaatttttgaaagaggacattttatgactaagaaggcatggaaaattaatgttactatcagatttcattggaagatgggataaaactagctcacagagatttttgtaagtaaaagtggcagaaaataaaattacataaaaatatacataaataaaacaaatgaaaatgcaaaacatatattaaaataatattaaaattcaagtattttaaaaataattatcacttagtataatcaaatatgccattaacaactatgtgatgtagttagaggagatatattctatgtcttgtttccccctaccagcatgagtgctaattaagaatatggaattattatgccatggtgggaaaggcagtgtgtctggggacaatttagtggattttaaactggtgctaatgctaattatctgagtgatcttaagtaagtttcctaatctttccagggttccctattcctcatctttaaaagaaggttattttatattattcagaaagtaacagtatggatctgagtgactataaactccaataataaagaaatgtaaagggaatataaacaaatgtatgcaaagtttccaattagaagcaaaactggacttaaacaggttaaatatatttagaggatgagaatttactgtggccttgatcagttagtataattttttacgccaaggctaccatcatttctcatctggactcttagaatagctttctgataggatactgtgctaggttctagaaaaattggtgaaccaggtgactaaggtccctaaacatatgaaacagtctttcctgggagataaatcaatagttacaataaagtcatgccttttgattgtggaatgtgcattagtttaaggagacccgttaaacttgccacttccccacctggtgaaagatatcagaagatgcttctaacaggcactgtcatttaagctgagcccaagggtgagtaggtagtcactgagatgagaagatactagcttatggaaaggcccaaagaatttgatgtttttcataacttgaaataaatttagtacggcctggagtgctgcgcttgagggatggaatggtgagaaaaaaaaacgcttgcaggatgaaaaccaagatcttgcagggacgcagaagcgtcatgttggtcccttgagagttgctcagagtagttgttgattttaggtaatactggagaaatatcgtctttaagagaaatgtagggaaagtcttaatgaataaatacagtacatatttgcaaattgtgttttgtttttttgaattgaccagatgttttagctcagtttcatcattattaatggtgatatggtaggaccatttcagtacaatgtgtgatattttggagttgatctggagcaactggagttttaaatttctaagaaaagaatggaaatgcctctttttcttaaggtgagtccagtgctacatcaagagggtgtttgggccaggtgcagtggctcatgtctatattcccagcactttgggaggctgacctgggcggatcacttaaggccaggagttcaagactggcctggccaacatggtaaaaccccagaggctgaggcatgagaataacttgagcccagaaggcaggggttgcagtgagctgagatggcaccattgcactccagcctgggtgacaaaagcgagactctgtcccagaaaataataataaaaaaagtgaagtttaatcttctggacaggataaggtcaaaattgtctccataagttcctttataagtttagatccgtttgctaggtgttctcagttaccttggttttcagaattgtacatagtacagtatcttactaagtttttgaagtatcttatccaaaaaaaaaaaaaaaaaaacttcctggtgtaaaaatggcttgctccccttcaacctgttgccctccactccatatttatttgagtgtcccctgcagttattgggtgtagagtacttaacagatgattgacaaaggtgatgaggagatgcagatgcagataataactgcatctgttggtgtttctcacataaatagcttcctcacctgggattgggaccttggacagaagtattcagctaataagatattcttatagttgctttatacattttctttgaggtcccaaactttttaaagataatatcatccatttctttgtaaataaggtgactaggatataactgtccttatatcagaggatataccagataattgctacttaccccgtggtcagagtaacctatgtcttgttcatgtcattttgacttccgcattcagaaaagagaggactcttcagccagcagtaatgtgcagtcttggcctatagaggcttccatacctccatatattcacagtttgctcctctaaggcataaaggcatattatcaaaatgtataattacagcttgagagcaataataggtgtaaaggtttttcaatattttgttttattttctgaggtttcaatagatctagtatctaatagaacagaaactttacagaaatattgaatttatatgaaaacccaaccaaataggaggtctgtagaaggtatcgttctagccacttcaagatggaagtgtctaatcagtgggatccctatatttaacttcaaagatgttatagccacaactatagctctttttaaatgcttttaaatgccatttgatgtttttttttcccctcattctccaaactcagtggccataatgcattgactgtttctgtgtggagagcaccatctgatttgttttattctgaatagatagtgcttctttttcataggtttttaaaaaataattgaaatagtcttgagtggattctttcagattagttatatgtaggtatatatacatatatataaagaaaactaatatgaatacattaaattctaaaattaataaaatttattttgctttagttgtttaaactcctgaatcattataatttccttttaatcatttttttttcctgctctttttccttccctttatgatcaggatttcaagtttattattgtggctttgtcagtgctttgaccctactctagtaacttcctttgacacaatgtgatacaaacgcatgaagttgatgttactatttattgtttttagaacattggatttataaaatcacagggacttagctattccctctccaatgtactcttctcagtattttgcaactacttaaagattttcttatagttgctttataagaactcttcagagccagaatacttaaagtattctgtgttttttgtttgtgttctctcagttatgtgtatctagttattataaattcctcacctactcataattgtgatattttatatattttccaattcattattatataatttacatcatggatctaaaaaaagatatatagaatacttcaactctgtttaatcatgacttttttttttttttttttgagatggagtctcgctctatctcccaggctggagtgcagtggcacaatctcagctcactgcaacctctgcctcctggattcaagtgattatcctgcctcagcctcccaagtagctgggactacaggtgcacgccaccacacccagctaatttttgtatttttagtaaagtcgagatttcaccatgctggccaggatggtctcaatccgttgactttattaagagatttttctataagcctgaaatctaaattagatttatagcacttatcataatatataattatatatttactttatactttctgttttctgtttttcacatgagattgtaatcaccctgaaggcaaagcctatgtttattttgatccaactttatacatagaacctagtggattgtttttatatatgtatatgtgtgtgtgtaaaaaaagaaatatacattcatagcaaatatttttggagttttgtaaatgagaagaagaaatttgaagagaaaatgagttttgaacagaaaatggagaaatcagattttcatttcagacagaccactgaggctgcattgaattcaatgaaaggaacaagatgaagagaccctagttgagttaaatggaattggtaggggttagaaagtcatatatttgaaggtgatttaaaaaccttactgtatttgttctctattactgctgtaacaaattactacatattcagtggtttaaataacacacgtttatttgcacagttttgtaggctagaggtctgacatggatatccctaggctaaaaccaaggtgttagtgcaactgcgttccattctggaggttctaggaggtaatccattttcttgccctttttaatgtctggagaccacccatgttcctcggctgccttcctctctcttcagagccagcaatattgcatttctgcctttcttctggagtcacatcttccactagttctctgtctctctcttctacttttaaggacctttgttattacatcaggcccacataaataatataaaatatccccctattttaagggcgattagaaaccttagtggattagcaacgttaattccatctgcaaccttaattttccttctccgtgtaacagcatatacataggttcctaggatcaggatatggacaacctgggagacagacatattattctgcttacgacatccagtttgcaaactgatagatttgtagttaatattgagggatgagttaaggataggatattggttcacaatttgtgtacttgggcagatgctgggtaacagttactgaaacagagaaatcaggaggtggtgcccatttaatgggaaaacagtgagttcagatgtgaacatgttacatttgagaggcctccgaattgtatctgaagcatagagggaaatttatgctggagatactattttggaggttgacagcattaaaataatagttgaaatccctaaactgataaattttctttgaaaatgaaaaaaaaaaacagagaaaatacagaagagattcctgaagaacataaaattttgcatttttcaaaatatggcagttttatggaatatgaaatatgagcaactgaagtagaataaaaatattaagataatttacacagaaactaattttcattgataaatcaatggttgtaagtctatacaactcttattattcttcatcagtaaaaattagaactgcagtatatttacctctgtaaaaggtaacttaagacttggcctgggtggctttcacctgtaatcacagcactttgggaggccagggttgcataaggtcaaggctaaggtggctcaggatcacttgagcctaggaattcaagattagcctgtgtaacatgggcaaaccccatctctagaaaaaagtgcaaacattagccgggcatgatggtgcacatctgtagtcccagctacttgggaagctggggcaggagaatcacttgagcaggggaggtggaggttgcagtgagcggagatcgcgccactgcacatcagcctgggtgacagaggagaccctgtctcataaattaaaaaaaaaaatgggcagtttatgacagaagcaacctggccacctaatattggactctatgcctaaaattttagcttcttcctcaaatcatgggtcatggtcagcaaatgtcattgtccttatttgaaaataaaatcaatctatagaatcagaattttactcacatgtaagaaaccttggaaaaaaaatattggtttataaatcaagtgaatctacagatagaactatttttctttccaaaaaattaagactaggccttctaaaatttagccaataaaggataggcaataactatgggaactataacatattttgcaaatagtgtcttaaatactagtgttatagttggcaatacctatattcgaaaattaattcctgtaaatagaaaatttatctgtgtttcttcagtgctgttcaaatttaagagctttaaaatgggtagatacaatcattcatttattaagtggaaatagatctagaggatttttaaaaagtaaaacagggtcactcctttctagtaatttagtactctttaagaaatctttatctgtaatttggtcttttgaatggatttacctgcagggaaggaggttccctggggagacaaatcatcagtgaataagtcaatctcatttataaatgagtctcctgtatgcctgattaacaagaaccagtctcctaaaatatgattatgcctctttggaaggataaatattaatcttctcagtcacaaaagctaaggattgaattttgaacctgattatttcactttgtcatcaaaatattaatagtttcggaacattatagatttcattgccataatctgtatcttgggtaatcaataagttaagaaaactgatcaatgtcttatcaaacctacatttgctgtcttatgcttaattatacttagggaacccatgttgaatgaaatattttccatttgcctagatgttaaaatgtctttatcctttcttttgcatttactttattgcagaaagttctgatgataaacaatttgacaatagtacttaatgatttgcttccctacagggtaatgataataatgcatttattgtattttatattttatgccaaccataaagcttccatctgtcattcttttctctatattgaagccatgctgctcttggcatgggtcacatttgtaaatgtttcatttatgaaccattcctcctcctaactcctctgcaatagagaaatatgccaaaaaagattaattgccttatagttcatgtgtctctaaatttggcatcacattcactgtgacatttcctcagtagtttccagtaggaatttgtcctacataattctcatgattttatttatcaaataattgtgctaagagctgtttaatgtgtaaatgatatgacaactggttgtcttaannnnnnnnnnnnnnnnnnnnnnnnnnnnnnnnnnnnnnnnnnnnnnnnnnnnnnnnnnnnnnnnnnnnnnnnnnnnnnnnnnnncataatttttaggcagtcaaagatgttgaaaatgtgggaaaatgattagaaaataagattttcatttaaattatttttgtagcatctcctcagaatgtatattattgtgtccggtttaatgacccaataaccatgttttgtgagcaggtgactgtgaaatctgaatgttcaggaatagaatttagttggctgcttgaagaatattggcagttcagctctaccttttttagcgtctaaaggaactagagtataggtaatatttcagaaatcagctggagaaagggggtgggggaatcaaaggaaaaaaacaccattgttcttagatctctcttgaatactcgtcaagtggattaattaacaagagagactcaaaagttgaagaagaggcaatcatgacccatgacacagcaagcaaatttttttgtgttactcttcttgtcatatatagggtagccatgctaccctagtagggtggctaagaagatcagagtctattgagagctaagttagggttgatactacgcttagagaattacatggtttagggtagagcaacacccagcaattagtagaataagaaatatgacttgaccaagcatacagtattaaagcaaagtatagaacccaggaagcagataggaaaagatgtaatctaaacagtgggaagtttcttgggacatgatagaagttggagatttaggaagtctctttcaatatatttctgtgaaaaattgcttgtgtgtcgtgatattaggtatgccatgaaaaagtcccaagtcagtgttacctgaaaggcgctgttatcaattcaaatttaacttggataaataaataatgcaaaagggaagagaagaaatgattattcataagcatatttgtatgctatttcagttaaattgttttcttcgtatgatggatgttggttatcagatagtaggggggataatttgaacactgtacacagtcagaaatggggatagatgtccagggtttggactgagagtgagcagtctgagggcagtcagtgcttcaggggttggggccaagctggagcagagaagacgactccaaaagatacaaatgtgtgttttgtcataacccattctgtgctcaaaacaaatgtccacttcgattttattttttctagagaccactttgcctcttaactacatctcagaagatcatatgtaaataggccttgactttttccatcgcaaaccaagtacagtagccgtttaaattttatccagcacctgccttcctgcttacactatactgcttttccaatagttggttaagaatgttcttttctaagacatacatttcttgctcatgatcccttttgattacctcattcattcattcattttcttcaacagatacccacaaacacccccccaacacacactcacacacatgttaaagtaatagttataattgtgctgtcttgatttggctgtaatgtcaatggacaaaagaattctttaattttaagttgtttaatatgtatttgtttcaaaattatggcagcacaattaaaatttttatctgataatttcttatttctgatgactaaaggttagattactaaagtgtttacctctgataatggttaattttttttttttttttgagacagggtcttgttctgtcactcagactggagtgtagtggtgcaatcatggcttgctgcagcctagaactcctgggctcaagcgatactctcatctcagcctcctgagtaactgggattacaggcacacacaaccacacctggctaattttaattttttaattttttaatttgtagagatagggtcttggtatgttgcttaggcttgtttaattcatttttaaaacatctcccactctatgtaaaacaatatctctttggacaaatttagcagacatttcctgtatttgggattgttttggagagtatcctacaggtaggaaattatttccctttctgttgtctactgggatgcatttagtccttggcacatttatgaaaagtgtgataagtggtacaattactgacaattttgatggtgattttgaagatgtgatatgggatgtctgnnnaaatgagggcattttaatctgttcctgctatatatgctataaactatggcatgtgagttgacacaaaaatccctagtagtgaaagttaaagtagaaaactggtacaccttgaaaggtaggcattgtaacttacagactttctatatcctatagcgtccaatatatagagtttaaatataacagagacttaagaaatgtttgttgaaataacatcaaaatgtatgatgtaaaatcaggtaacatttcttgactgcttaggtcctagttagggaagttaacatctattttcattatgtccatgtaaatgtaatggagggaacaaacaaaactgcaggaagaaaaattttcccatcttcaagaaaaaagactaaactttcattctcataatttttttcacagactcaaagttatttttttcctttccaatataaagccactgttatttttttttaaagtaacggtttcagtagtttcttttagacctttcttccattatatagaaatggttttggattgagatggccattatattgtagatataacttacaagtaagcagttataatctcttttatcaggaccattaaaccaatgatttaagtgtatttcagaccttaagtttcataatattcttcaaaaaattggaaaatgtccaaagcccataaaagactagtgggaacataagaaaggttagaactagaaaggcaagacacatgtttgatgctgtgtaagcaatggggaacatgttcaatggtttgagctaaatggggcacttctttgtgagagatgagagactcgcaacatttattaaatataagactagaaaatctaagactatagccaaatagtcttttctacctatttaatccctgagtaattgagacaaatgtaaataatataggtctcaactgaatttgcttacgaagtgctgaagatgtcaaaatagaggaagcatctaattgctattaattagggacatgccaaattttcttttactcatttttaaccacacagataacagaacaattttataggaaagcacaacttttgaggtaactcattaataaatatcaatgaccttgctcaggagcccaggagggaacctgtagtttggtgaccttgtgatagatcacatccacacccgagttatcctttggtctctgtggtaagtgctggtaatagcaggttttaggaatgattataaggctgaagcaaatatagctctgtcagtcaggataaggatctggaggttcttggaatgagtgaaataagaaggtatgaaagtcaagatgaacatttctagtaatattttaatcaactattaaccattcattatttggataaggttttcagtgatagttcttgctctagagtataacttgctttctaagtaatagcaaactgcttcacttgatttatcctgaaagtaatttagttaggtagaaaattatatagcttgagtgttttgcccttttttttctatttaagataacagtgaagaaaagtaattttttatttttataccttattttagtaactaagggaatcatctatttttaagaagggacagagatatttgaatgttttctgaaaaagatactctctagcagagtagaaaactgaaaggtgtaatttcaaaagttctagacttgattttattctctaattagaaaaagctaacatcactatgttcatattaccttatacttacaaatagaatttccaatctcagatgtaactgaagggatagataaaattaaaataatgaacaccctctatgttaaaaacatggaaacaagcaaaaaccacaaaaaataagaataaccaccacaacaaaacaaaatgctgtaagtacacctactaaacaaataattgatctcaggttctagataaaagtagctttgttgtttttaagaaagtatgatcctctttagaagattttatcttaaaatattccaagtacagagaggaccataccaggagtcaacataattcagtgttgatttaaagcaatctatgttagatttttttcagaattaaatatggttgcaactccgtgtgagggtagttacccatattatatatatctgaaagtaaaaatttttggttcttacctttcagaaatatacagtgatgttaaaactggattaatttgataatctaaatgtcagtttaaagcatttaaacagtattatatttaaatggactgcttctaaaatgtaacgtataaagatacatgtttgtttatatatctataattcgaagtattctctgattgtatctggtcatgatgttagaagtattgtctttgtttattggtgttttttaagagctattggaggtagtagagtgttacagttagtggaacatagaaccatcataaacctctactgatgtgctgttactgagtgacttagtaactttacttagtaactcagaaccttaagctgggccttaaagcttctaaattgaatgattctaggaagaaaccccttacttttttttcataaggtttgttagagaaagttctcaaacatgtatttatgattgtctgaactttaaaacatattgataaatctttggactcaatttacatgacattgacttaaatttttacaacaaaattatcctaaaagaatagctactttcttagtggcttgatttatctcttccttgtgtaatttttcaaagtgatatatgaataaaatctcatccttttcttactgtgctatctgaataaagatgatcttctattatatactataaatcaatatgctaattgtttttaaactaataccttttagatttactgaaatgatgtagataaagacttgataaaatatttaaaggcaagaagttaatatttagctttttattcttaggtaatcataactttcagatttaatccagtactattaaatttgtgtttatcatttgatattgtcttttaaaacattatgaaattttcttataatttccaaaagcatgaataaaggcaactctaatacactaaaagacatgttcagaaagaaatataatatgctgaaaatttttttctaaaagttaataggaaaattgtatgcagttacacagacacattctatgcattatgttgcttacaaaacaaaatgtgtatttttagaactttattttattgcccccaggctattttttttgttttattcaatttctcaatttatgctatgaataaataattgtattttcatttgtactctttacataaataataggtgttaatcttcctatttaaacattgctattatattaaaaatggaaaagtattggcttttttactgatgttaatgctgatgtaattttttttcttcctactgagtttacagtgtttgttgctgtctggtagggactaggtaacttttgtttggagccagcaggaggagctctcaccttgctgtgttcaacgtaattagtgtgcctgaaaaacctgaatttgtgggggttttgtatgtgaaacaaatgataaaattaaaatatttactacatatctctaaaattctaaattttattttaatattgaaatataattcacctgtctgaaatgcaaatttggaatcttatttttttaaagaatttttaagaggtatcattgcaatttaatcaaataaagcagttaggtcaatcttgtttctggaagatactaagaaacaacaaaaaatgttttctaagcatttgcactataataggtacatacatattttccttttttacttgttttgaagtgaatatacttcacagtttacaactatgaatactgagaacaaagcaggcttaatatgttttagaaacaataattaaatgaattaatgaattaacttattggtcataattcctatataaaacttataaaaaggaaatagctgttgatagatttcaatacgcattagagattttagacacttagctctaatgaaagccttgatttgaatgttgtgatttgtaggttgtaccagtgaattttctgcagaaatctttgatgagaaaattagaataaaacttatgaacatttaaaaatcaccataagaaatactgatgtttctctccattaagtgaagtacatattaaaacaataatgagttactgttgcacacctgatagaatgactttaaaaaactggacaaaaccaagtcctggtttgtacaggaatgggaaaaccatacatttccctattgtgaatctaaaatttcacagcagtcagttttggaatccagatggatagtttatttaaaaaacaaacattttctgtataacccactaatcttactccttgttattaaccctggagaaataaaagcataggttcatataaaaaatctgtataggaaagcttagggtggcctatgtataatgttcttaactggaaatagcccagatgtccatcaactagggaattccatacagtggaataggtttcagcaacaaaaaggaacagttgaaacatgcagtgacatagatggatctcaaatgcatatgtgaagtaaggaaaccaggctcaaaaggctacatgctatatgatttcatttatttgacactctggaaaagacaaagctacagggaaagaaatcagattagtggttaccagaggatggggtaggaaagggatttcttataaagggccacaagaaattttgggagggtaatggacgtattctctagcttgattgtagccatggttccatggatgtaggagtttgtcatgatttacaaaaatgtacatttaaagagggtggatttgttgtgagtcaaacaaattttaataaatctaactgataagacatggggaaacttatagatttaaaaaaaacacttaaacaggaatgccaactaacttattagcatttatttgaatctcggcttcttttcaaatgagacaataaagaatattgaacactgtctggatatgtcattgcattaaggaatttttatattaatgaattaagatattgtaagtatattaaaagagtattttggaaatacatgttgaatttttatacaggtgaaatgataagattcctgaaatttacttcaaatgaaatcttatagtggggaagtaggtaaaaatgtatacaagaaacaagattggacattaattggtaattattgaacctgagtgatgagtatgtgagggttcattgtactgttttttactacttcaaaaagtatttgaaaatttctcacaataaaaattgattaaaatttatgacttagttttacaaatgtatgtttagtgaatagattttaacaatactaaaggaatattctgcaatgagtaagtagagtttaacccaggaatttaaggatactttcatatctgaaaaatgtatcaataaaatttatcacagtggttcacctaagtaaaacctcagaatctttagagtagacaccaaacagcaggtgccaaataacatactcacaattgcattttaaaaaattatagatgagaaacccccagccaggtgccttggctcacacctgtaatcccagcactttgggaggtcaaggtgggagggtcacttgaggccaggagttcaagacctgtctgcatagcatagtaagaccttgtctctacaataaatgaaaaaattagctgggcacagtggtgcgtgcctgtagtcccagctactcagaaggctgaggcagggggatcgccttgagtctaggagttcaaagcttcagtgagtatgattgtgccagtgaactccaacctgggcaacagagcaagacctgtctctttaaaaaacaaacaaaaaaaaaaaaaaaaaaaaaggaaaaagaaatctcacttccttaacaagatgaaaaaccaaaattaatgatgtggtaccaaagcattgtttctcagagtgaggttcatggcctactgacatctggaggcctaggaggtagtagttaaaaataaatatctgctgaatcatgagctgtccacatttacctgccagaaacgctacaaaaaccctccttagttgatctccatctgtctttcccaatcgtttctatcatctaactttccccaagtagtctccacccctacaactgagaactgatttagtcatatttcagttagtttatagaaagtattctaaaataaaaaaaaatcttatcatatctgattgaaaccccctcatcctagaccagttcaaattggatcccgtttgtgaagttctcccagaactgccaacccaactttagcttaacttaattgctaagatgttaatataatcttcacttttataacttaacagaaaatgttgttatgtgtttacatgtctgcttttttgacaagattatgaattacttttggtcaggaaaagagatagatggtttttacgtttggtttcgcatcttatagccataagtaaactacctagtgtatataataataatgtagtcagtgctttaaagattataagatttttcaaaatgagtttttttaatacttggctgataatatataaggacatttaatagcacaaaaagagaatcaagaaatctgctttaatacaggattttcttcctgaatgtggtctaaaaatactgtaaatgaaagtgggggaaaagcaaaggtagttattttatcagttttaaacatctgctattaaaaagacttaattctgtttaataatttcatttagcattgtttaacaaaaatatacatactttaatttctaaatactttatgcattttatcattacttaatactattttatattaatatttaatatgtaaatttctgaagataactcattaaacttaattcagtgaataatagtaagtgtaattgacattaatgatttttattataactttaataatttaatatatttttgcattagttgagaaattcatggaatttttattttctatttaattccagttgtgttgcttgatacaacaactgtactgggagagctaggatggaaaacatatccattaaatggggtaagtttaaatatctgaaaaattgctgtcttttttagatttttaagatctcctaatagttgatggaacagtgaattttgggccctacttgttatgaattttgacatataacttacatcccatagaaaaggttaaaatacaattagaactggtaatcagtgggaatgatatgtaaagctccttcctctctcctaaattagtaattattctttaatactgtgtttatacatagtgacattagaatatctcccatataaatattttccttaaatataaatttctgtgtgtaagtttatatatgttacatttatgttaaatttgataacctcgatgagtatttgtgcataaataaactttaaactactgtagtataaatggattgtgcaaatattaacaatttggtttttaatacagaatacaagtctactaaaatattatgcatttttgaacttggtgaaaatatacaaggtgattaggtttttgttaactgaaatagttgtatttaaaggcttgttaaggatgtgtaatttgcaaaatatagtttttcatggaccaacattttagctatggttgtacttgactttttatatatttttatatattttgcatcattttcatattacaatatatgtctacttctcattttcacactgagctaaaataaaagggtggtttctaaagcattttgctttgatttttgtctagttaatcaaaatattgaataatagaggcagtcacatgttttcagatacacttgggttagctttcctttttttccttagaaatggtaattttcttattaatcacattcttagttgacattttcacattgcttcttctattatatctttcaaatttaaacctcaaaggagaaattgatccaaaatatgttttattcttttagaatctttcacatattgctgtttgaatttgacattttacaacaacagttattcactaagtgtgtattttcaactaaaatatcctatgaagagtgaaatcttcctctctttaacagcccatttgcttctttaaatttgtaagttttatatactgcgagtttatttttctgaaatttttgtttattctactagagctcttatcaaactgtttctgaggtatatatcttaaactaggattatgcttttatcttcattgtcttatttccattaaaatgaataaacattcgtattgttgagtatattaagtgggtcatgtttttacttttaagaaatgaatgaaacttttctaaaataccttttgtgtgtgtgcgtgtgtgtgtgtgtgtgagagagagagagacagagtgtgtgtgtgtgtgtgtgtgtctaatcttatgaacagtagaatggataggtggtataaataagattttaaaaatatgcaatttatttattttttcttttttagtgaagaggatagattactggtactaatggagctttacttaatgctatttataggttaaaataaggaactattcagtaaggatgaagaacttgggaaagaggctactgaaaatgccaagaatgaaaataatctaggtatcaatataggttacagtacttaaaatccaccagaaccattaatcagtttataacatgtaaaccagcatttatatcgaaacattaaaattgtaattatatccagttgaaatcatataaatttttcaggtactcagtttcactgaggcatgctcatttgattgaccattttaacaattacacttttacatagacactaattcaattgattttacaaatatgtcatgggtggaagagacatgtagacaatataattggcaatatatgaggtaaagtatgtttggtattataaataatgtatttctcaggaataactttttaattgaaaaaaactcttcctataaagaattgacatttttgaaattgtataatgtgctacataaaatataggtaatttaatcattgattccatagatttttctttttacttaaattcatcattccactagtaatatcatgctgatatagttacagaattaggcattcagagtgtgcctgtgaacagactgataaatagtcatttcagtggaaaattgagcatctctggtggttagtaattatggaaaaaggatgaatagtctgaacaaataacgttttaggcttacagaaatgaaaagagaattatgaattttctaaaacacttgcttatcaattcatttgtgccaacatttaaaatatactttttcttttaagcattgtcctgaattcaatttaacaaacttctgttttatgctgctctatgccaaataccctgttattgtgcctaagacagatttttctaccctcaaggggtattgaagcacagcgataattatacagaatcactaggccaaagaatgtgtcttcaggttgttctgagtaatgttttgtgaaagaataataaaaggagaggttaattctggtcaaggaaaattgggaataagaagttgcatgtcagctctttcaaaaaaaaaaaaaacgtgaaggaattggccttgaaaaaaaagggagaaggcaacttctaggcgaaaggagtggcttgagcaaaggcacagaattatttcatgtatgtatcaggttttaggaatgctgagaatcatttggcctgtagggttgcagtggaaataatcatttggctggagtggaggtatacagtgagaaataggacctgtaatcataggctaaaccacattttgcaagacttagaatttcactaagttgaggtagatagtgcatatctctgcatcagtaagttaacttttaaaacctatgtttaatgtgtacatagtggatgagatctttgttacatagttgtattggacttagatatagccactatagtatataaaatcagatatcattttcaacagtggagtacctgttaattaaacattaagacaaaattgatgttaggaaaacaaaagtgctgttggatgttacatcacattttattttaatggcaattggagattagaaatctttgtgtttctctaatactgaatattggttttgaatatcatattttatagataatttttgtgtgctctgacttagatgatcactagggcttcagcaatgcaatatagtacaagatatgtgatcttatctgttggacatagtgaattggtattaggaaacttaccctgaaatacttcatgtattggtcatggttctttagagaaaaagaactaataggaaatatatctgtatctgttacacatatctatatctgtttttctacctaatgagagagagatttagatttattttgggaattggctcacatgattatggaggacatgaaatcccatgatctacaaactgaagaacgaggaaagttggtggtgtaatttagtcctagtccaaaggcccggggagtgggtactgacatcagttcccaagtctgaagacccaagaacgaggagctctgatttctaaaggcgggagaagacagatgtcgcagcttaagaagaaggagcaaatttgtcctttctacatctttctcattctatctccacttcagtggattggatgaggtcaagttacattagtgaggaagggcagatattctttaatttatctattgattcaaatactaagctcttccagaaacatccttacacacacacctggaaataatgttttagcagttatctggaaataatgttttagcagttatctttagcctagtcatgttgatacataaaattaaccatcacagttaggaaaataaacatgtcattcatgtgtaaataaaagctgtaagtaaacctaacaactaatgatttttatttttataataaaagaagcagagattacaatcaacctctgtagaaagatactttattccattaatcggagcccatcatttcctaatataatttttccaaaggtgaaaatcaaaggttggatgtactatgatagagaatggagtaactaccaataaacatttgtttttataatgcaatttatatatttcatatagtaagaagtaattcatcatagtagaagatttcagtattacattttgattcatcctaaaattgaaattatccaaaactataccatgtgcatattcaagttctgaaaatgtaaattttggtgataatttctgttggtgaatatggattgctatagttactgttttcaaactgatatttaaatattttttcttcttagaaacttcacaacatatatggtaatgttctaaacacccgtcatgttaatttcaattatattgttccatatttcaaagaaatgcattaggttttgttaattaatcaattctatcagtgtacatttctttaatatccatgtttgtaagacattttatagctgtgaggtgttaattgccatccacataagggaaaggacttgataatagtactcatatcattagattattagaaggatgaaattatgtaatatatgtaaagaagttaaaacaatgtctggttcataataaacattacataaatattatcattaggagtagtgcaagaaccccaaatattttaaagaaatgaaaaatccagacttctatatagaccatttgtttctttgctttttccagaatcatgttttatcatgtatcaaatatttttttttctgaaccacaattatatttttgtgcctttgtttacttaactaataaggcaaaaatgtagaatgagtacttttttcatttaaatataaataaaatatacatgtacactcatttatttaatctttcaccgcacattatgtgaaaaatgctattttgtgtactggaagtggtggtggacatggtcagtcattacaaaaatatatgaaccctcttaggatctagtactagttatgatctttagctgtgaatactatatccaggtttgcttgatatataatcaaaacatatgttatattttattaagttagcttcataaccaagaattgccaaagcaaatatgggcagtaataatagaaagactcattgaccctagatgtgagatttcagtgtggtaacggcctcttaaaagatgctgaatcgaattaaccaggagatagaatttgaaggccagtgtgttaagttccttgaaagcatttccctagaaaagaaaagtaaacctggatactcacttggaagcgatagataagcgagacataattcttacatttcttcatttggtttgatgagtcaaatattttaaaagatcagcctgcaaatgaacagcctcctgcacaaaatcttatgtgatagctgagcatatttgaagatggtcatgttaagtacccaaactttctcttataatcatttgcagtaggaggaacacaatctgcaaagccagcgtttgtttcttgagaccattcctttcaggggcttgtccctgttgaagcacatgtcagcacaggtgagctcatgattgcctggagatctccttgtggctcctgtgacaagcagaaaggaacacattgtaggatagaagcctcctgtgtttatggagggtggcttccaaagttgctgtctcctctcctcttccttgctttatgtagatttaaatttctgacctatttcatttttcttctctccaaagaatgttttttaacatttcttgttcttgcaaggtaagtctgctggcaacacattctctgaattttgtttgagaaagtctttatatcttcttcacttttcagggaaaattttacaaagtacagaattccaggttggtgggctttaacaaatctctaaatactttaaatatttcactccactgttattgcttgcatggtttctgaggatgaattgtatgtaattcttatccttgctcctctattcttaaggtgtttgagtcttctggattctttcaaggttctttatatttgctttttttttaaatttgatgtgaaaatattttttgaagtttgaatacagtatatgtaggtatagtttttctggcatttatcctgcctagtgttctttgagcttcccgaatctgtggtttggagcctgacaataatttggagcaatgtctgtgtcattattgctttaaatattgctctcttcctttctctttttttccccatttgatattcccattacacataaactgttgggtttctgcttccttaaattatgattctcaggccgaggtgggtggatcacctgaggtcaggagttcgagaccaacctggccaacatggtgaaaccccgtcttcactcaaaatacaaaaattagctgggcatggtgggtacctgtaatcctagctactcaggaggctgaggctggagaatcacttgaattgggaggtggaggttgcagtgagccaagatcatgcccctgcagttcagcctggaagacagagaaagatttcatctcagaaaaaaaaaaaaagttatgattctgtgtatccaccagtccatctctccaattctggggcagtgctttacccgctgatctaagtggagttgttcatttttcagtttgttcagctttttacttgttacaatggagaagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttttaggaatttaggatttctatgttaagagttcaggcagaaatagcagccagaaacatctgccgtaaagacacattgaaagtatacatgcagaagggttagagtagggggacttgatgacctgaagtcatgtgcaagtaacagttctaggagagcagggaaaaaaatccaataactaaagggaggccattcagtagtaggaggagaacatagaagatgcagaggaaaagccatgaagaaaggaaagattaaggtagttagcacctgtagagatgaccaagtttctgctgaatcttcaggtccaattcttagtttttcttaaattccttttatctgggctgccagattgtaaatacagattgtacttataataataataataataacagtgaaacaccagcaccattttgagacagaacaggaaacatgaaagatcgtggaaggtagaatttccttgaggagaactcaggcacatgaatcatccaaagctgatggctttcttttatcagctcatgcatgggtaaatgacctcccctacatccaggtagtgcagagaaacaggtgaaggaatatgcatagtttattatagagtccctaaatttttaaatatttaatactcgagcaactatgatttgtgtcacttctttctccactatctcagaatattccttcctgtacagcaacctctgcaaaagaaaatgtattgctgcctcatttttcactagttgaaagagcatgttttgtagaatgatgaaattctatggtgaggaagaaaagtaacagaaaagcaggtaacaatgatttaataaatcagatgtgaagtatttattgatgttcctgaatatgtaatcacccttgtattctctgggcagctgaaaaataagtatgtatggaattcatttttcagtatccccactgttctttaatgaatagccatgatgatgtctttctgtaaaaatatgtagatgtataatacacattacacacacacacatacacaaacacacacatctttaaaaggtatgggtctcattaagtcaaatcttcttgacttacataaaacagtcttttatttatttttatttttattcattttatctttatttttttcattgttacttacaaacctttaacttcagtctttacttccaagagaagtttctggttatttcttttaaaataaattcctatattgtaaaatataaactaagattctgattttatcagcaagttctaattgttttacttagagtcattaaaatatttataaactattttatttataaataaaataatctgtatctaaatccagagcaagcacatacaaatgctaaattatcttaggaaaccctaacatattattaataaaatacatatattttttttttttttgtagagatggggaggtcttgctatgttgtgcagactggtctcaaactcctgggctcaagtgatcctccatgagccaccatgcctggcctagacatttttataaatttaattattttctattttaagtgataaatttactcttattttctacagacaactaccaaatcctattgattcaaccttcaaaagctctttcaaatcagcctatatcatcagcttcatctgtcactccatcatcagtttgactcttcatcatttcctctccaagttaccatagttgcatcctagattgtttacctgctttgggtctttctccagccccttcttctgacctttccaacccatccctcatcctgttgccagaactgattttctaagctgaagatcaatttatgtccatgtcactactctactaaacccctcctctcctttcctaccgtttaacctgtggccaacagctgcctcttctgatcttcatctttaacattccctgatcttcagccacctccactttccagctttttcaaaaaagacctttttggtagtttcttccatatgacttgctttctcttgtctctggatataggaccatgcttatgtctatctggaatgttcccttttatctctcttcactccaacccccactttctctatctcactttttcctattggtctcttaagacagaaattttctgccttttctggaagacttatattgccaaaggttgaattaggaaactccttttctgggaccacctgaaactcagtgcatatcatagcatttatctcacaatacttaaatgtctatcttttaccagattgtaaactcttgcagtaatggattgggtgttgtgtctctgggtcaggtagatggcatagtaagtgctatatgagggatgctcaataaaagttggctggatagctaagtagatgtacatgtaacaaattattttaaataagatattgtttaaaggctatattttgcaactctcattggagctggaataatttgatactaactttgggcagaatcagttgtggaaaaaagactaaatggttgtgaaaattgaactgtgttcttgttcatcgttagtcttaagtacaggtagaaagtgtatacatttgctctcattttttgtattttagacaatccattttctcactattctctcactaaaatagaagtttaaaggtggaatggaaagatattgacctacaaaataaaaagactacaaaatagcctataagccatttaagtaatacctatcaagacttaataatatactttcaaagaattaatgaccggtttagaacagttgatgatctgaatcacatctgggaattattcaccccaggtggttattaatcctgcacccttgtaattaagatgagaataaaaaatagaacatatggatttttaatgagtgatagatggaccgcaaattttagagaattaatactaaccagtgaaactttcaaaaaacacaggttggcgttaaatgttaaataggtttttgtaatctgtatccatgccattagtattttgaattaatgtaccatagtcagcaaaatcgattcttaaaatgaattgacttggttttattttagcaaagcaaaacctgttgtgctaataaatataatgcttaacttagtcttcttcttccccataattagcaatgtatatgcaaatacttcaatgaaattaaagaagtctttcatcaaaagcatggagttaggatttgcgtgtgtatatagtatgtgtgtgtgtatatatatatatatatattttttttttcctttggatgttcatgcatcctaaaggccatgtttgggaggataaaatgaaatttgtcctcttaatttagagagtttgatttaataatgtgattaattaaacaaattataggcttaccttaaatgcaatgctttctggtgcacattagaaggaattttatttatggttaccagtgaaaataagaaattctcatattcattataaatatcatagtaaataaatatgtacagccaccatattatagttaatttgtattctttctgttgataagcattatactaatcgtttggatgaccataagccctagtgggaacagaattggcaaggcacattagaagacatgaatggaggcccatatgcctggaaaatagagagagagagggggagacagaaagattgagagagagagaaagagagagcaagcaagagaaggaaagagaggtgtcaaggaaaaacagataaaagggccttgtaagtgatgctaaggcatgccattattatcctaatttcagtgtaatttattagagagtagtaagcaaattaacattttgaaaagattactgtaattgaatgcagatagaatagttagaaaaattcaacccaagcacaaggaacttaatagtctagatgcagactattaagttgaatatttgaatgtaatattgtacatttgacaacaaaagctattatgagctaatgtcattaaatattatcacatagcccccagctatgttatgtctatctagatatacaatctgtatcattccaacaaggccgtcttccttacaaattactatttatatgatggttttgaataggtttttaagatttgaaatctctaagcctccaattttaattcttttgtcatagagaaggaataaaagttgaatggtgaaaaacatataaagtgaatattcacaaatattgtctatacttttactgatttatcctcaatatttaacattagttgatagcactaagtttgccatcaataaatatcacttaagtgaaaactgaataaattgattattattttgagtattagaattattgtagaaagatatatttcacgcaatatacagaacacttaatatggtgtccacattctgcctaatttaattgaaatattgtctattattaggtttaagactttgtaggattatgttttcattatttcactgaaaatctgaaaagaagataaaacacttcagagggaaactatgaatgttactgtatttctttatttcactaaagatccatttctagcattttgcctttgtttataaacgtaatttggataacatttatgaacataatgctggatacaagatcaatatatgaattcaaatttatttctatctaccataaacaaacaaaaaataaaaatgtataacatatcattttcaacacatcaaaaacacacacttttactgcatgaactcatgtgcagagtctagagaatttgatctcatagaattagtgagtagaatagcagttagtgggggatagggaaggtacaggggagggaaaaagagacattggtcaatgtggacaaagttagagttaggaggaaagagttttggtgtcctattacacagtggagtgactatggttacaataatattgcatatttcaaaagaactagaattgcttttggcagtatgattatttttatgatactggttcttcccatccatgagcatggaatgatttccgtttgtgtcatctgtgatttctttcatcagcatttcgtagttcttctcgtagaggtctttcacctcctttgttaagtatattcctaggaattttgtttcattgttgtagctattataaaagggattgggttcttgatttgattctcagcttggtcattgttggtgcatagagtgctaccaatttgtgtactcgattttgtaacctgagactttactgaattcatttatcaaatacaagagtcttttggaggagtctttagggttttctaggtataagatgatatcatcagaagcgaggaggataggagggggcagtgaaggatgaaaaactacctattgggtacaatgtacgctatttgggtgacctctacactaaaagcccagacttcaccactatacagttcatccatgtaaccaataaccacctatactccgaaagctattataataaaaaatttaaaaaaataactataagagagaattttgaatgttctcacctcaaagaaaagataaatgtttgaagtattggatttgctaaataccttgatttgattattacataatgtatacatgtatcaaaacatcacactgtaccccacaaataatgtataattatgtgtcaatttaaaacaaaataaagttaattaaaaaacccacaaatacttaaagtatcacaaatctaagaaaagatgtgcgagaacattgcattgaaaactacaaataacctttgaagaaaataaagacatatagaaattgaaagatatacctgttcatgtattggaagaatcagtttaaaatacaagtcaaatttctcagtaccctgtaaatgtaatgaaaggaaacacctcagctaatattttccccccttttaaaaaaaattgagttgaaatgaacatatcacaaaattgaccattttaaagtgaacaactcagtatcatttagcacattcacaatattgtacaaccactgcctctatttagagtgaaaatatttcatcaccccatatccattaatctgttgcaccccattcttcctccccccacctcacgcgctggcaaacactaatctgttttttatctctgtggattcacctattctgtgtatttcatataaattgaatcgaacaatatatgacctttttgtgtctggcttcttttacttagcgtggttttgtttcatttgcattgtataatgtgtcagtacttcctttttatagttgaataatattacattgtatgtatatatcagttcgtttatccatttatatattaatgaacatttgggctttgtgcacattttggttactgttaattgtattgctgtgaacatgtgtgtacattatttgagttcctgctttcagttattttggatatatacttaggagaggaatttctgggtcatatcccaattctgtgtttagctttacatggaaccaccaaactgttttccatagtggctgaactatttttgtgttctcatcagcaatgtgtgagggttccagttcctccctatcctcaccaatgcttgttattttccctttggttattctttttttaatgtatgtagaaattgataaatcattgtattagtctgctttcacactgctgttaaagacatacccaagactaggaagaaaaataggtttattgtagtcaaagttccacttggctggggaagcctcacattcatggtggaagatgaaaggctcttcttacatggtggtggcaacagagaatgagagagaagccaaagcagaaaccacttaaaaaactatcaggtctcctgagacttattcactaccatgagaaccgtatgggggaaactgactccgtgattcagttatctcccacaaggtccctcccacaacaggtgggaattattgtgagtacaattcagtgagatttgggttgggacaaagagccaaaccatattattctgcccctggcccctgtcaaatctcatgtcttcacacttcaaaaccaatcatgccttcccaaaagtcttccagagtcttaactcatttcagcattaactcaaaagtgcagagtccaaagtctcatccaagacaaggcaaatttctgcctatgtgcctgtaaaataaaaaacaagttaattacttcctgggtacaggcattgggtaaatacaggcattccaaatgggagaaattggccaaaacaaaggggctacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggttctccatgagagccctgcccctgcagcaaacttctgcctggacatccaaggtgtttccatacatcttctgaaatctaggcagaggttcctaagtcctaattctgttttttattttatttttccgtaagttattggggtacaggtggtatttggttacatgcatgagtaagttctttagtggtgatttgtgagattttggtgcacctatcacctgagcagtatacactacaccatatttgtagtcttttatccctttcccacctctcaccactcccaccattccccccaagtccccaaaatccattgtgtcattcttatgcctttgtgtcctcatagctttgctcccatgtatcagtgagaacatacgatgtttggtttcccattcctgcattacttcacttagaataatagtctccagtctcatccaggtcactgataatgctgttaattcattcctttttaaggattcgtagtattccattgtgtgtctgtgtgtgtgtgtgtgtgtgtgtgtgtgtgtgtgtgtgtatagtcaatcatcaatctatgtgatatatatctcacagtttctttatccactcattgattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattcacaattgcttcaaagagaataaaatacctgggtaatctaacttacaagggatgtgaaggagctcttcaaggagaactacaaaccactgctcaatgaaataaaagaggatacaaacaaatggaagaacattccatgctcatggataggaagaatcaatatcatgaaaatggccatactgcccaaggtaacttatagattcaatgccatccccatcaagctaccaatgactttcttcacagaattggaaaaaactactttaaagttcatatagacccgaaagagagcctgcattgccaagacagtcctaagccaaaagaacaaagctggaggcatcacgctacctgacttgaaactacactacagggctacgatagctcatttctttttagtactgaataatattctgttgtggatgtacctgggatttttgaaaatggtatcctgtacgtattttggatattttccccaactatttttaaataagtatgaaggcaaaaactgtttttttaattgcactttggcaaagtttatctttgcaagactcttaaaatggatatagtcatctaaaacttggagtgtcttatagatcagttgttttcatatatactttatttgcttctgtatgttctatgtgtcattgaggaaaatttctatcatttcttgtcaactaccacataaagttgattgtgattcctccacccatattcctttacagttcatatgtaaccttggcataattttggctgttttgaaacttaggaatcagtgcattgtttaagctgtaggaagatatcttagtaattcttattgatgttactttttatttccctgaaagtcaggagaaggaatattagatatgtttttgaataagccagctttatggaaaaaaaatgctaagtatttaaaatgtaattacactttgattaaaataaatgaataaaatcttattatatagattcgtggtaaaaggaaagtctttatatttgattagtggtgtttcctctatcttcaggtatgcctcctttcaccacaagctcaagactcaagaaatttgtacgtatatagcagatctaagataaatgaaaatctggtcgcagttctatttatcaaacaaaacacctatacctaattgtcaagattgtttgctaagtaaaaattaatctgtattgatgtaccagagaattggaataaggtacaaaagactaaagggcaccagaaaagatggattgcttgaactgagattggctttactcacactgcaatgtgtcttttgactgtgtgcatcctaagttgtgagtgactgggacatttggaggttatgccgtggagtcctgctatgctgttgaccatcaccatgtatggtgttttgttgtatgccgtatatcccttttcataatgctcaataaaattggtgttggatgaatcctattgtctgttgcacttgattgctaaatcaaacccaagaacattgctacagttttacaagtgtacatcaggtcgaaaataaatgagaatctggcccagttactgattgatagacggagaaaaaattgtaagttttttttcacttgttttgaatttaattctaatacaaaatttaacttaaatcttaaaaacaaaaaatattacatgaaacaaaaatagctattagtagcaaaaggtgtgcagcatataaaaaggcagtataaatctagctgttgaaagatgggctgggaattcaaaattttgcagtattacttattagctgtgtgatttgggccatgttacctaaccactctatgcctcagtttctttatttgtaaagttaggttaataataattaatgacatgatgggactttttgagaataaagtgagatttttataaaaagtatatatataacattgctgtgtaaagttatctattagcacatgaaattaaacctctctaaataataaggattgtaagcaggtgatgtaggattacaatgggtaataaatgactaatattaaaaggtaggcaatgtgtgtggggaatttattttattccttaaatacttgactaaatgcaaatacattttaaaatcatatttatttctctaacttctatttaaatgtcagtatttttaccactttcttctctgcttttcctctactgcttaaacttactctctctaggacatctcatttatggctaccatgaccttagaaggttaaatacttatcaaaatatgttctgtagcccagactttttcctgaggaccagcaccattttcctaattgactaccgaaaattaaagtcttaacattaaaccttttgtgttcacaagttcaacattcatagctttgaagtctttgtgtccttacttttccttaaaatttatccttctgtgcagtgtcttctaacaaataaagttctattcagggagaccttacttttaaaacttccattaacttgtcattatctcaaattactgtgtttagcagacattaaaggatcttggaaacatggtgtgtgtcactttcccagcttcatatttcatctttccccattagtctaatgttccaaccacaatgcccgtcttagcatctcgtaatttctcatgtgcttctgtatacctattagaggttctctcattctctagttcttggattgtccaagactactcatgccctagttcaaatactaatgccatgccctcacctataaagtgtaggacctcttaggcagagactgtgcccctgtaacaccctttgcacaatactggtatactggtgtaagcctctttgcccttgatgttctgaaagatactgagttgcatttctctctctcatgaggttgcagctttgtgaagtcaggaactgtgtctttttctcagttataatatattagttcatggaaaaatcactgtattggatttttaaagttgaaccaatgaaacaattaagcaatggaagttgaagagaaataaatcatcattattcatgggtggtaatcttccaaagatactcttttgcttaatatctaattatttgttaactcttgagcctcctgattctataaaattatttttgagtgttgctattgtagtgtatatgtccaagttcaacttcatccactttttattactgtttgtatttatattgctatatacacatcataattgccttttccatgttgatatgccagttttttactagtgtctattatgtctacctagatcttcattattgaacatttaaatgttttttattggaatttgttatctaagagaattagtgatggctaatcataattttcttctcatttaacccagctttttcttttattctttttctgtttattgtttatgaattatatttagtgttgacttctttgctttttttttacttagttaagaactgatattcagcgttggcagtggaattatgatagtaaaaataattcttattccttagttgcttcactgttacagattttattttcaagaaaagaataattgagaaactgtctagtagaaagtaggttttctccagcatggtcagtaatattctgccaaccagagactagcccatagtctatacttttttatactgtattactttttacctatcacttgatttaattctttgttctaacatactttataccatattagtgacataaagaaatcaaaatatgcctttgttaagttttttatttttgtattgaagataaagttatttaatcaatcagtagcatttataaagtaatcattactaacaactcagttattattgcctcctaactaaaaaggcacgtaactctttgctaagagaattcaagtatttgagagacaatctttgacatcaagatgctgatgatatattttctattaagaatataaactctataaatcatcatcatcatcataattctggtttactagtatcttattttatagtttattaattatcttcacttgtggagatatgtcataacatcttcataataactcgagggagccatattatgtcctttatggtccaatatagacctgaaaatcagataaatttaagcaactaatctgatttttatacaaatcagagtgccgaggctgtggattaaatcatatcttttgattgaaatgtccaagttatattatgcagtttcttctttatttataaaaccagaggacaatacactatagagtatgttatttatgcaaactgaatatcttaggtcatatattatagcagttgagagaaagaagctatctctgtggcctgcagtagtcatgaaaattagcatggtctccaggaaggaagaaagataggagttaaggagttgacttactgtttctcagcaacctaggaaactatggtgtacttggtttgatataaggacagactaggtgggtatacttaatcttgacagtcaaggttcttggaaaatttaattatttctcatcactcagcctgggtacttgtcctcttgttctccattgtactaggaagagaccatcatcattcagcattcctcactacacccatccagacaagaaggtgagctacttgtggtctgacgcgtgttaaatagcttgataagcactgcctagtacagtgcctagcaccgaatagctgttttctaaacttactttctgctatagtttggatgtgtcttgttcccactgaaactcatgttgcaatgtaattgccaatgtaatggtattgtgaggtggtagggcctttaagaggtgtttggatcgtgaaggctttaccctcatgaagggtttagtgcagttctcacagggctaggttagttcttgtggtgctgagttagttcttgtgagagtaggttattataaagaggtttggccctcttcgtttctcttttgcttgtgcttcttgcctttctgccatgttataactcagtatgaaagattttaccagatgttgcttccatgctccaaaattgtgagcaaaataaagttattttcttataaattatcctgtctcaatattgttatagcaactgaaaatggactttctgttacccagtgttaacattatttgacctttgccagatgcatagtttgcaaaagttttctcccattttgtaggttgtctatttactcggttgatagtttcttttgacgggaaatcaaatactgcatgttgtcacttacaattgggagcaaaatgataagaacacatggacacatagaggggaacaacactgtagtatgccacagtgtctgtctgtggagggtgggaggagggagaggattaggaaaaacaactaaagggtattaggcttaatacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaaaaatgtaggctgggtgcagtggttcaggcctgtaatcccaggactttgtggggctgaggcgggtggatcacgaggtccggagttcgagaccagcctggccaagatggtgaaaccctgtctctacttaaaatacaaaaattagttgggtgtggtgataccgtgcctgtagtcccagctactcgggaggctgaggcaggagaatcgcttgaacccaggaggcagaggttgcagtgagccaagattgcaccactgcactccagcctgggtgacaagagtgaaacttgtctcaaaaaaaaaaaaaaaaatctgaaccacagtgatgagaaaaattaaaattggatgagctaaaatatttacagacttaactgaaagtatattgaacaaagcaggaatgtgctgagtgattcagagacttttaaaataagtgtttacaaggaatcattgaagaaaatttggataagagtaatggcattagtgaatcaaaatatgagatccaaagaagagggatatctacaaagttgctgagaatttgaagataaaaaggagaaaataagtgttgacagtgttgcatggctaaagatataactatggtagacagacgttctcaatttaatttttaaaatttggacaaaataaagatacaaaatgggacttctcatatctggaaacctttttatatatgcagaagcaagctttacttagttttaataaaacttttcaatttcacaatgtagataatttgtaactgggaatatatcagagactcagagaatcttgtaactgacaagtatactagaagttattaaatttcaatcagctgttaatttctgtcaacttagccctgattggtgttgtgaaaataatagaatccttgagagtacataatcaactcacattggagttctcagaagttaagaaaacaagtgggctaggaaaagtaataatttaattctgttaatttttagttagcttgaataaagagagagattctaatgacccatgacccacatgtattgaaaacatgttgttatatgtttgtttttacttatttggcattccttttttattgccaaatactattcaattatatgactgtattacattttatttatgcattcatcaggtgatcatattgggttgttttcactacatgtggaaactgaaatatttgaccaaaagacgtagagaaaatgtggtaaagttgcacctcatagcaactagcttaaaagagttcctgaaatctcagcagtgggagtttgttgggctgtactttgtattttccaaaaacgtgactcaactactcattgaatattagattctttctccatgctctactgttgtgtcttgaccagcctggttgacatggtgaaaccccatctctactaaaaatacaaaattagccaggcgtggcggggcatgcctgtattcccagctacttgggtggctgaggcagtagaatcacttgaacccgggaggcggaggttgcagtgagccggtaccccgccattgcactccagcctggatgacaaaagcgaaactctgtccctaaagaaaaaaaaaaaaaagaacttgactttcagttctgccatttgctaattctctgactttgggatgttagctcaactttcgtaaaactcagtctccttatatgtaaaatgtgaataataatattacctacctcataggatttttgtgagagctaaaggttatattgcatgtaaatctctagtacagtggttttattcattcaataaatactattaataatattgattacaataatagtcaatgattttcatttacttgcactggttatttgcatggtgttcttattgttagagcttttatatcaccccacagaacctctgtacccattaacagtccttcattcctcccatctcaagaactagacaaacggtaatctactttctgtttttatagatttacctatagttggcattttgtataaatggaatcatgcaatatatgtggtcttttgagtctggctcttccacttagcgtggaactcacccatgttgatgagagattctttctacttaggactcactcatgttattgagtgattctttttattgtttagtattcctttttattcccgaatactattcaattgtatgaatatatcacattttatttatgcattcatcagttgatgacattgagttgttttcacttttttctagtatgagtaatgccgctgtgaacattcatgtacaagtttttgtaaagcgtatgttttaaattctcttgagtatatacctaagaatggaatgctgggtcatttggtaactctatgttcaacatttgaaaaaatttcctctgttttctaaagtgactgtgccagtttacattcccaccagaaatgcttgagtgttccaattgctccacattttcaccaatacttgtttattgtctggtgtttgtttgtaggcatcctagtaagcgtggagtggttttatattttggttttgatttgtgtttccctaatggctaatggtgttgatagcttttcatatgtttattagccatttgtctattttctttagagaaatagctattcaaattatttgcccatgttaaaattgggttatttttatttttgttgtctagttggcagaatacttatatattctggatacaagtcctttatcaaatatatgaataacaatttttttttctattctgtaggttgttactttcttcatggtataatttgaagcacagatatttttacttttaaagtgtaattaatctatttttattatagtgttttccttttgatgtcatatctaagaaatcaatgactaattccaagtgacaaagatttactcccataaattcttttaagatttttatagtttagcttttatatttaagtctatgaaccatttttcattaatttttgtgtattgtgtaaggaaggggtctgactcatttttgtgcatgtggatatccagctgtcttgttttgtttttcagtaataaatacattgctcatgaaacagaaaaacaaaaaaaatcaaaacgaaacatagaaaaagacaaaaagggaaccacttctgcttggagagaatagagaaaatttacttaatatgtaatatttgaagtatttgaaagtttcccaaaatgtgaatagaattgggatgagtagagaaaaatatgagggcaagaaaattataggcatagctggaaaagagaaagtgccaaaaagttaaaataactatttcattttggcaataatatactttacagagaacctggaacctaaccataaacacaccctgagaaagtgatgcaagtacgagtaatgtctttgaggagtgcctcagagttattttaccctggaggcaaatgagctggtgtatttgtgaaccagttctttagagtactttggtaaggactattttgaggtatgtggcctacatttagttgatgtgctcagggtctgagatctcatgcagagtggaaagtggtcttggagaatgattttttctttattggaggtgagagccattaatgggtttgaagtcagtatcctcatctttctctcttatttctgggcatgtcatgatctgttagccggttccagagatctctgtgccttagtactccctggttgccactcaaacttggcttcccgttttgccacttttggcaattgcatcaaccttccctcttatagttaagtgttgccatctggcctctgctattcttaaacctcatcatttctactgaaactagggaacgattttataagcagatcctaccccaatcttcaaatatagtctacaaagtacaaaaaagactgagttttcatgatggagtgttctcattagcacatttatcttttgctttaaggaagagtttgtctttaggaccatcacaggaacatagccagctggtggattctctagtgttgtttaataaatccatgtcactatgtctttgaatcttttgacaccttcatcaaaactttatacaggtattttttaactcttttattctaggttgttattttatctacatacttccaagaagcatgcttatagtatatcatagctgatttcagctgctgttaaattctgagtcataggtgaataatctcatatcaatcgactctgttttacctaccttctatccttctctccctttccactagtcttgagatccattcccaagcatggtttcacagttcttgccagttcatattagccaggccttgcaggtcttttgatgaataatcccttcccttacaatgaagggagaaaacttgtatagctggattaaactgagaattgactgtaatggttgacctagaagtattaagaagagagggaaggaagagcttgaagagggcaggtttcatcttgccagacatctgaggtaaggcctctgaatgcccctcaggcaaagggaggctactgtcctttagcaagagtgattgagccacttttgtaggcccacagacaggttttagggaaatctggggctcaagttctcaaatgtatctattcatctctattctataacttagaaccttatccatctgtcacttacttaagagatacagtgatactgcaaattcattcttctttacagtttggttcattgcacagtcagatcctggtcttggtttgcattcctgtttgtcttttgggtgcaggagaaaagtgtctttatagatgctattatgaaagctttgtatttcacaccatactctgagttggaggttggctaaattgagtgtgtcattttttacttcgcttaataaattgatggcacttaacaataaccactgtctttataatttcctttgctatagaagaataactttctccaatcctagatattttgcataaactagcacagcccttctacctgtgtgatacacttcagtttactacaggtaagaatgttggcaattgagatacttcaggatgttagcctatccacaatcctacttaccaccagcagtggagtccttgttatcatttggccagtgagtaatacaagcactaggatgtctgcttcctagaataattttcataccaattgttttagttgcagtttccccatagctgattttgagataggaattttaagtgcaggtagtttatttgggagattcagggagcatgggttggggaggggaagtgatacagaaaaaggatgactgcagtaaagggtgctttattaagctacttaacaccattgataagtggagcctaatcctaccaggacatttgaggaaatcacataaaacacgtctcatgtactaaattccaggaattatttgctgagggcttttcctctagggatgttgattcctcagcactttctgacctgatgtgtacacagacagagaaaccttctgcagttttgttggagacaaaacccagccttcacacacagagctgatgttagagcatcctgaaaggtctaaggaaatgggcagagctttgatggcatctcccacagaacagtgaaatgaaagttaattggtgtcagaccatggagagcattgaatgccattcaaggaagtatttagacctgatattctctaaagcagaaatgtaacatgataagaattgtgctttaggatagttaccccaaagtattgtgtagaatggattagagaacagaagctagagttgagagtgtcatggaggaggaataacaatgatgatcttcatcctgtttccagttctcactgggaattgctcccagttctaatactaaacccacttttagacggcctaactagataacattctgagcccactccatcaagagaatttcagataaagagattccattttcaaaagaattgagaatttagtcagtcagaaaatttgcactgtcccttttaagcttaatttttttttttagctaaaacaaattagccttatttgctcagaaacagccttatataaagagaaccaacattgaccttgcctgtgcttgctaatttaccatacttgtttattcacctctaagtgccctttgaatcccatttagtaattcatcattcttgatagtagtttaccaaagacaaaggaatagaaattagctgagtaagagaaaaacaaatgaaaaggagggagcatttcaggcacggtggctcaacacctgtaatctcagcaccttgggagtctgaggcttgcggatcgcttgagcccaggagtttgagaccagcatgggaaacatggtgaaaccctgtctctacaaaaaatacaaaaattagctgggcatagtggcatgtgcctgtagtcccagctacttgggagactgagacagggggattggagaatcgcttgagctcaggatgcggaggttgcagtgagctgtgatagtgccattgcactccagcctggatgacagagtgaaactgcatccaaaaaaaaaaaaaaaaaagaggggcactaaagagagcacttttctgaataatcccaaaccaacttaaaagggtaaaaactaggcaaagaaaacgttttcatttgctcagcactaatctagtaataatgcgttagtttgtcattttcacatagaacaccaataaaccaaaacaaattaggctaacttggatttccatcccctcatgcacaaatttaatcccctacagatctttagccatatttctgggacttatagtcaaaacccctcttcttttcacctttccaatattgaggactttgttactgggtcaactgtcaatagcctttcttttttattttggagaaattctctataaatgtatgctttttattgttacataattcaatgcaaagacttctgtagggtttagcagtttacaatatatggctgggtatttccatatctacagtggaggcaacttgagtccatttccagaaaactcatcatctgtcatgcagtggagctctgttgtctcctgctaattaaacaaaagtgaacagatatgccagaatacaaagtggtgggaataaatactgtggtttcagttgtgatctctgctacacatgtttatataaagtaaataacatttgcggtaatcagtttttataaaactctggctttgagtaaaataataattatatttcaaagatgctataaacctattcttcaatttgccacaatgagaaggaagttcagtcttttcatgtgcctttattccagacatccaaatctctagaatggtttatttatgtataagaagtaagatccagtagtctttttaaaattaaaaatacacattttaaaattaaaaataatatatttttaatatttgtgggtcctaataggtttatatattatgggtacatgagatactttgacatgggtatgtaatgcatagtaatcacatcatggtagatggggtatccatccaccccctcaggcgtttgtcttttgtgtttcaagcaatccaagtatgctcattcgttattttaagatgtacaattattattgaagatccagtagtcttgccattctgcagaaaagaggtggcccctgaggctggaaggcccaatcacagcagcctgttaaaactggttgattatttcagtgccacattattatcatcggtctatgcaagtcctctcttgcctttatttattatttaatactatttcctactcacattcttctttgttcatcttagacaactgttctattttgtttgagggggaaactttaatttgtatgtattattaaacaatgtgaattgttttgtgactgtgttgttttggtttttatagataacattgtatcatagatctgattttgatccttactatttttttcatcatctctttgttatacgatctgtgtttgttgctaggagtacattgactgttttagcactgattgatgcatacgtttcactgtttagatccactatattttatttatccctaatgattatctccaatttccagttactacaaaacatgctctgatgaatgtacttatccgtttccagttatagacttgctaattatttccctgggatatatgtatttgtgagtgtgtgtatgcatgtgcacattgtagagtatatgcatactcaagtgctagcaaattactctctgtaatggctgcaaaagtctactgtcttcatcaatagtattgtcaaaagaaaaacttcagctgaattaaatttaaagcagtttaattgagcaatgaacaattcacgaatcgggcagcccccagaatcacagaaaattcagagagactccagggatgccttgtggtcagaaaaaaatatagacaagtaagagaaatgatgtacagaaatcggaagtgagtttcagaaacagctagattggttgcaggttggcatttgccttatttgaacacagtttgaacacttagcagcctctgagtggttgaaatatggcctctgggattggcctagactcagttactgttacaggagcatattcctaagttagttttcaatcttgtctgcctattaagctaggttacagttcatctacaaggactcaaatatagaagtaaggtgtttttctcaggccatatttagtttgctttaacaccgtataaggcttcttacttacctacctccctaacaatacttgaaaaaaattggtttttcatttttacctatctaatgggcctaaaatgttactctagtgctgtttcagtatctttatattttaatgagtgtgtgaatcttctcatatacttgttatttcaacttacttctggaaaatgtccttataacatctgagtattttaaaaaattggagaagctatcttgttattatccatttgcaagaattctttatgtagtttatattttttcttacagatattaatgctgcaaataacatatataaacctgtcatctaccagttttatgtatgatgttgagtagaaatccttactttttacataatcaaatttaccaatttttctctttatattttgtacttcagatttttatttaaggagttttatccagccctcgttcagcaacatttgtttatactatgtattaatgtataattttacctttcgtatttaaatcagtattctttgaggatcaaacttcttataaagggtttatgtagagaggcagttttatttttcttcatatagtaagccagtttgctactgaacagccagaatagttgcactgtgattttgtatgtacaatttatttgatacttacttctcatgtaaacatggtcttgtttgagctctgtattctgttcccatgatctatttctctgttattgtgttagtgaacaaaattttattactgtggaattatagtatattatatatcagtaagacaattattaatttaggatatttttattgaataaattaggtattcttgaaatgttattctttctgtgagttttaaaataagtttactgagtttttaaaaaatgttaaactggtattttgattagaattgaattgaatttatagataaaactgggggaaattgttatttacagcattaaagtatcccatcattaatacggattacagtaacccatccaagggcatcaaatgtgctttcatttatttaggaagtcttgtgagacccttacagggagccagctggcaaagcagaaatgtgggttgacagggttcagtcctagtgccatagagcagagtacagaaaaatgcctctgaagccaagagacgatgacttaatgattactcagataggaatttactgtttcttaaaaatttggttgaatttatttaaattaacttgcctagagatttggcgtaattacgtatctgctcccaaattagtttaagcaatgtttttgttgttactgttattactttttagggggagagatttgtggattttttgtagtaaataaggttgttatgtatttattatcacaattataggaattttccagaattgattaaggatattttagttttctatgcttggaaactgtttttgtgatgagatttatgctgacacaaggaaaatgacatatttttatgctcacacaaggaaagtaacattctcttttacaatgtgatttttcttctttctcaggcgtatataattattcatttttctattaacttataaactattgcatttactttaaattttgtcctaatatttactgtgttaagtatatgttagatcctttaagtatactgacttctaacgtaagcttcttgcctgtgggaaccatatttaattatgtgtagcatttagcttaattctgtgtcattttaatttttaaccacttaggaaaataacattttccttgtgtaagcataaaacttatgaaaaatctaaacattcataagtcatgaagaagaaagaaaattcattgataatcccctctttgaaaaataattactcttgtttcaggttttgaagagaactttcctcagctttgtgagtgtgcttcaatgctatgaatacacacacacacacacacacacacactttatgtaacataggttatataataagaaattattatataattttagatgatatatattatatacaacttaatgtattacattatataatatatgatatattactgtatgttttaaaaattattatagtttactttttgttttataattaaatttttcatttactagtatattatgaatacttttccaagtcattgaatgtctttttcacgctgaattttactgactgtatgatattctgtcatttcactttgccacaattatttttcaaactttattatctcatgataaaattctagaagcagaattactagatcagtgtcttaaataacttcttagaatgtttacatatgttgccaagtttttcatgattgattatcgtgtaccaatatctttttctagaaatccattttaactgttttggattattttgttttagttgttatctttttaacaacatagaattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcagttggattttgtttattataagatctgggagtctttatcttttaaaagtggatatttagcaattattgtttgacaattgacatgtatcctttgtcttctgtatcctttgtcttctgttatgagctattgtataccttttatttatatgcttactatttttttctcttctctttatgactcattctgtaatattttctgtagtttacaatgtagtttttctattttatcgggtgtatataattatttattttctattaacttataaactattacacttaatttttgttctaatattgactgtgttaggtatatgttagatcatttaagtgtactgactttggatgtaaacttcttccctgtggtaaccatatctaattatgtgtagcttttagcttagttctgtgtccttttaatgtttgaccacctaggaaatgtgtattgctttgcttattggatttaactgtaaactttaaattggatttaaattgtaaactaccatagagaaaatggtaaaagcacacacacacacacacacacacacacattctatgtattttgagagtagcttcaaaaaatatttcataaatattttttgataaaattctcatttctgtctcttaagaatattggattaattagaagtatatatgaggaattaacatttaatcatttttgtcaagtacttaggtacttacaatgaacctaagtacaaaagtacctaagtacattggcatccatataatgtatttcagagctgaaagatttatattcccaatgtgaccttaaaactctgtgtgatgcatcataaggttctttactgctatgctaacagcaattttagtttactattctgtgcaatataatgtgcaatattcagggatagattttttccttgaagtttgctaagcgaatgactattaagcattgttatttagttagcctcaaatattctttttctttcttttccttaagaaaagattaatgaaactttttctaaaggttgtttgaaatagtagggtaagtttattatgctgtctttggcatattacacagtagtgattgcaccaaatctacataaatgcatatggttctttataagcagttttacagaaataatatagtaaatctaaattacactctgggtaattaataatttgtgaaattaaaaaatagaatgtagaagaaattctcaacctggttcagcagtttaaaacaactcttctaacttctactaatttgatatactaagataatttttaacaattggaaatcagcaccatggaattatcataaaagaataatacctccactttgagaattttcccattatatatgtacttacatgttgtgtttaagaatcactaaatagaaatatgctatacaaaattaaataatataaccaattgtaattttattcaagtcagattttcatatctggcaccctataatttctactgttaagtcaattaatgcagataaacctcatttgaagccattggaatggccgatgatcgtggatataatttctcatgtaggattctgatgtcaagcaagctttgaccttccaagaaccatccctatacaactgaaatcctaaatagagctataattttaattgaaatatgaaggtctaatatattttgaaaaaccaggtcaaaacatatatcattgtgaagtgttaaagcaacattagtggtccaaaatataacctaataaggtatgtacagaatcataatcttaacttaaatggttctctgcaaattttatttccatgttgcatatctttaataagaaataactcttctccagatttctgtgtgaagattgtgcttctgaacaaaccaacactccaccaaatattttcttgtcatggtcactgataaattttctattaaaaatctagtatacattgagtggtttttatcttagtggatctttcagcatcatttaatatgctaaatactttctccttcattaataatttcctattgtaatgtgtacaggacatcacactctcaggagatttgtctatcaatgtacattaacatgtccagtttgaatattcatttcatttatttcatatgtgatgtttataagaattatcaattcaaaagttaatacacttaaatattataccttttagttaaatagaatgttactcagagtcagggctatagactttattagtaattacagcaaagataagtgattttattgaatctgtaaatagtctctttttattaaagtgcttctccattaaaggatacttcctaagcagcctgaatattacttcacctgttcagttcactctctctcctgacacagacacatagtctaaataccgttttcctcttctctgcctcttcatacacacacacacacacacacacacacacaaacacacacacacacagagcgagagagagagagagaaagtgcctcttagttataaacctgagttttcatcctaacttataattgtgtgcactagcatgatgtccagtgagtcatgtgatgtttgcaagcttcagctaagtcatatgttatgtttctgttcacctgagctcatcctggtgtctttaaaatgctatggctaggttaggagattgctaaaagtttacatattttccatctcatgtcatatatagaatcattacttgagcaggagtagctctcccattagtggaagcattcacagttgttttagttataatttaagctttcttattattaatttgtatatttaacaactattaagaaccaactgcaatccctgttgtgggaacatcctatgggaggcttgtgtgggaagctctatgatgaaaagacaacgtccttgtcctaacagagcttacggtctacgtaaatttatcttgattcaaagccttcatgtggtccaacataacttttcacatacttttggtgttaattcttctgttttctttgtaaactcagatgagtcaattccctcctttaaatcagcttcctcatccataaatcaggataatatgcttcattctctataacttacaagaatcaaattaaatgtggtttgtgagattatttttctgtgcttgctatatttggaggtcctatgtaactagcatagtattcatatattgttgaacataagacagggtaattaagataaatatttgcaatccctttatttagaaatcctataaatcttcaaagataatatttgcaatattttatttatcgttaagtaagaatctcaacttcgtaagccatttaaggccttttggacatacagaagatgaactgtttaataaatttaatcttcagaatatgacagttttatgggataatctattccttcttagtagaagttatctttattgctataatattttaatcttgttaataggacaaatctaccaaaagtaaaacatttaattggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgcagagccttcactttttctgctgcaaaaacagatttatgttattaactacatgcctagcagcagaattcagggcactaattttctaagtttatgtcagtatattgatacaaagtgactaagtagttctgaggaaaatgtaatattagaataagaagacttctttaacaagctttactttgatacagaatattagatacgtatgtttaaaaattaagccactgcagaattacagaatgagatacccgtgtacattcaacaaccttagtttatttggcttatgcaaggtaagatgaagaatgtttggaacaaatcacatatgggccattttgcaacttttcattctcagccattctgcattcttaatcttagaatgaagttgaagattttatttccctttttggctctctttcccatttaaatttagttgatttggaggaataattaattattggcatatactacaaaacattgagaacatattatacaaaaaacctggctagaaattatagatttattatgattttgttgttgtatattgttttaatctatctttaaattgtcttttacttttgggaaaaaataataatatgctgtatcatttgtgtattaatcatctaccagtgtaatgctagctaatttaaaaacgcatttagtcttttggattctatatctttcaaatggtcacttgttatattctattttccatgactattccccctttatatatttactataaatacattttgaagaaaaacaataaagaaaaatattatctccaagtatttatgtcctttttagtctataactgggatctgttagaaattgaggaggaaataaatttatgccttaatagttttagtattagaggatatggtcttacagcatgtaattaacaaaaatcaatacagaaaagggaagagaggaaagagatttcagaaacacacacacaaacacacacacacacacacacacacacacacacgtatttaggaagcacaggtaaagacgaaaatatgtttctccaacagtcccagtcttccgtgttattagaatatttccttttctgttacctactgtcagcatatttaagattggttttaactgatatttcatttccttaaatcagaccagccttgcagctgtttaaggtcctaaggcatctagggtgtgacttccctctcccttttctctctgggatacatacgcaagcacactggtctgaaggtaaatgctcttttcttttgctatgttttgagtattttatcaggacttatccttgccatttgaaaatataattagctttccaatagtccgttctgtgctaagaaacaaactatctgctcctattttaaaatttcaaaattgattttggaaataaaagtttatatttctttgaattctaaagattttcagagggaagaagatataaatttgagagatttatgtaagaactttggatgtatgtgtccatttgccagcatattatctgaatattctttgcctagaaaggctgtttgattgccttattttgttctccaagaaaagaaagccatctgattcctcaatgactgccagttgctttaagaattaatttccttgttctgactttctatacccaaaaggaatctggttttttggcctagtttatttagcttgctatagaaacaaaaattcatatgtggatgtagaagggtttttagagaatcctcaggcataaatattaaatagattaattattactcatagctattcacatttcctatcacttctaacaaatattcacttcagatgatacagcccccaaaccactaagctatatgcacacactattggcaattttaatcctgtaccatgtatatccaggaagtaaaacttcttaccctttttaaaacaaatatacatataacttattctttagctgcgaaatgtttagatgtacgtaagtttggtaattgtagctattacaggtttaaaataattcaatctgtaattattataaatatctatatcattataaataaatctgtcattaaatctgtactattaagaatctctatattgctgggcacagtggctcatgcctataatcccagcactttgggaggctgaggggggcggattgcctgagggttcaggagttcgagaccagtttggccaacatggtgaaaccctgtctctactaaaaatacaaaaaaattagccaggcatggtggcatgtacctgtaatcccagctacttgggaggctgaggcagggaaattgcctgaacccgggcgtgggggctgcagtgagccgagatcatgccactggtctccagcctgggcgacagagcgagactccatatcaaaaaaaaaaaaaaaagaaaaagaacctctatattatataatatataatatgatagattctgtatattatataatatatgatataatagattctgtatattatataatatataatatagtgtatacataataaatatacatattataacagaatctttattatatataatatactgtgtatatttaataaaatatataaaatatgttattaatacaataaatatatataataaaattatatatttgtagtatgattaataattataaataatataatgaaattgtatttataatataaagctttattatacttataattataaataatgtattaaaattgtattacacttataataattacaaataatatattaaaattatattattaattattgatatattattaaattattattataacataaaattttaaaacctggctttttggcctagtttatttagcttgnnnnnnnnnnnnnnnnnnnnnnnnnnnnnnnnnnnnnnnnnnnnnnnnnnatctgtaaattatatatgtcattataaatacttttgttattaaatctgtactaagttggtcagtttggtcaggtgcttgcttttacataataggcactgaactaaaatatcccagttcctctgtctctttttttttttaatttatgttttttatgtaatatttaaaatatcaatatataaaataactcaccaatatagaaagtagaaaagagctcagtaaagcaaaaatcgaattatacatgcttctacagaatagaatatcttgcaaactacatctattcttatgtcctggataaatagaacagagagactcattttgtcttatgttcattttatgaatccttttttttggatcaaggaatgactatatgaggaaattttgccagagtctcttgttcaatgaaagcttttggttaagcaagaatcagctgtcctttgacaggatgccaggaggaatgtcttaagatccatataacaatttattcattctaagacatacatgttgaatacagtgtgataaagtcagtgtggtcataggaggaaatgagaacaaggcccggaaagaagtttattatactcataagtcccagagagggggtcagtgcatgccattcagggccacacaggaagcactatgttttggtcaggtggtagaagacaggagtgaggggcaatctaggctagagcctttactagggtttctgagggaaagacagggcggagcaaagcaaacactttggtgtttgcttagtttgaataattcctgtggaatttgggcaataggggtggtctataagtaccagatacctgccctatgatcgatcatctagggtaggggaaatattgccttgatgtgtgagagtaacacatcataaggaagagtttggggctgtagacttgggaggggcagacttgcatatgaagctccaggcccagccctttgctatatctaataattggctagcaatgagaagtgcagtttctccacccataccatctcctctcagcaagctttttaagaggtcttaacgtcatagaatacgtaaaataaagttagaagacctagttctaattctagtccatgaaacactgggtaattgattttattcttgggtattggattccttattgttattatgaaaataaaaatacctgtcttgctttattggaccaatgaagaccaaatgagttaacatttgtgaaaaagttttgatgaatataagttcagtatataaatagtggccttaaggatcattacatccaaggtaaccttgtagtacatgaaagaaagaattccttggagtacaaatcattcttgcttaaccaaaacttctcattgagcaggacacttagttacaaaacttttccatccatctctttgtcatccatctgtccactccttgatccaaaaaagagctcacaaaatgaccatagacagaagttccttgttctactcatataggtcatgaaaacagaaattatttgcaagattttcttccctgcagaaacatgtattatttaatttgatttatttaactcttttctacattatatattagtattttattgtaagttctacataaaatttttcttaaaaagcatacatgtgattgaggagttgtaatgttttgtattcattacctattatataaaagctagcacctgacagaagtgcaaaattaatagcaaaattaatgacaggtttgataatatactttatcctgtaatttgtacatttaccaggtttatgcatgtctaagtatttcacagttggataataagttatatgtttgttttaaataggggtaggaactttaagtgggacagaactaaagttgtctaaaagtgtatgcatatagcttagttttataaattaatttctattcactttcctccctctggcttattgaattttataattctttattgttcaagtccagtgcatgcttcttgtctgagccttccaaacaactccagttcatgagtgttgctgtcctttgaacacttactatattttactatataaactattagattgttacacttaaacctgcactaaaatgttgttaattaacaattaacattttaattaatgcttattaacacatgatgtgtagaggtgacaaagtactttatgacgttaaaaaaaggcttttaaagtaaatgtttacactaactacctaataatgaagtaaaacataggtttttaactctctttgctattaaaaaataattccagtaatcttacagtccaaattggattttaaaaagaattatgatcatctttagacccaggaagggaagcctctactccatgctagagctttagatggtcttgcccgttcactcctctggctacattacccttcatgaagatatgaccttgagggataagaagatatgccacttagatcttatggtttatttctataccatagcacaggtattcaagaccctagactttcttgctcaaatggccttaagtctacttttaggagcttcacagattcttcctgggattcatcctccaaaggatgtactgtgacactggtgtgctcagcctaagttcactggaggactaaagttggcagctttttgaaacagggaaaagacacagcttgtgtatgagatgctcatatatgtgcatatgtgaagtctgtcagggtgtgagatagagctagagtcaggtaagggcaaagaagtgggattaactgaggttaagagctggctctctataggccactacatgctgcctagggtcttaggagtccaagtattttaaatatgaacctggattgtcaggttgttatgaaagtatctttacaaagtagactggtactgtatattttaagtttggtctaatttaaagaatggaactgcaggctattatcttaaatgaaacaactgacacatagaaagacaaatactgcatgttctcatttataagtgggagctaaataatgtgcacacatagatgtacactgtggaatgatagacaatggagacttggaaaggtgaaagggtaaaaggggggtggatgatgagaaattacttaatggtgcaatgtacattattccggtgatgagtacactaaagccctgacttcaccaatatgcaatatattagtgtaataaaattatacttgtattctatacatttatacaagtaacaaaagatttatcatttaaaaatattaaggcatgtggtatgtgagctgccatactcatattcttgccttgggacccctactttttagagaccctatttaatttaatacttgaaattataactaaaaggttaaaattgaccccttgaacagcatggagattgacctctgtgttattgaaaatccatgtataacatttgactgtccagaaaagttaactactaatagcctactgtttatcagaagccttgttgataacataaacagttgattaacacatagtttctatgttatatattacacatactgtattcttacagtaaagtaagctagagaaaagaaaatgttattaatcatagctgggcatgctgcctcatgcctgtaatcccagaagtttgagaggccaaggcaggtgtatcacctgagctcaggagtttgagaccagcctgggcaacatggcaaaatcccatctctacccaaaatacaaaaaattagctgggcatggtggtgcatgcctgtagtcccagctactttggaagctgaggtggaaggatttcttgagcctgggacatggaggttgcagtgaccaaaaattgcgccactttgctccaacctgggtaacagagtgagaccctatctcagaaaaagaaaagaaaatcataaggaagagaaaatatattgactattcattaaatggaactggacgatcatgaagtggccttcatccttgttgtctttatgttgagtaggctgaagagaagggtaaagtggaagcattggtcttgctgtttcagaggtggcagaggctgaagaaaattcattgtaagtggacctgcatagcttaaacctgtgttcaggtttcatctttatatataaatgcagtatttccaaaaggaaaagtatgcctgaaatgtgatataatttttatacctactaatgttatattttatggcaaattccataggcttttagatctatatcaatcttgaatctatcttcttgttttagggaatcagatccaaatttgtatatcaatatatattactttctatattcttgaataagatgaaatttaccaattatgtctgttttgagtgttttggtacctaagtctaattctaatttattttaagtagaagaagaaacattatttttcatcaaacatcacaaactcagtgtaaaaaaaaatgcatcattttgttatgtatccttatgcactgtatttgagaagaataacatttccgattacctgtgtgtattttgtacttctatatttcttggtttatatcggttctgattagagaatacatatattttttcacttcagacccttctctcattctgaacatctccgcaactgaatgtatttgtaaataaggaaatattataatttcataaatgatattttcaaacacttcttcatatttgagttaaagttaatctcatattttcagagaattaattttttgttgaacatggttaatgctttttgttaatatgaagtgatgaagatactaaaacagaatttacagggaatataattctttttttttatactttaaaatttctagggtacatgtgcacaacgtgcaggtttgttacatatgtatatatgtgccatgtttgtgtgctgcacccattaactcatcatttacattgggtatatctcctaatgctttctctctcccctccccccaccccaccacaggccccggtgtgtgatgttccccttcctgtgttatcattgttcaattcccacctatgagtgagaacatgcggtgtttggttttttgtccttgcaatactttgctgagaatgatggtttccagcttcatccatgtccctacaaaggacatgaactcatccttttttgtggctgcatagtattccatggtgtatatgtgccacattttcttaatccagtctatcattgatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccttaacattttttcctccatttcaactttggtgaatctgacaattatgtgtcttggagttgctcttctcgaggaatatctttgtggcattctctgtatttcctgaatttgaatgttggcctgccttgctaggttggggaggttcttctggataatgtcctgcagagtgttttccaacttggttccattctccccatcactttcaggtacaccaatcagatgtagattttgtcttttcacatagtcccatatttcttggaggctttgttcatttctttttattctgttttctctaaacttctcttctgacttcttttcattcatttgatcttcaatcactgatacccttttttccagttgattgaatcagctactgaagcttgtgaattcatcacatagttctcatgccatggttttccactccatcaggtcattcaaggacttctctgcactggttattctagttagccattcatttcatctgttttcaaggtttttagcttctttgcgatgggttctaacttccttctttagctcggagaagtttgattatctgaagccttcttctctcaactcgtcaacgtcattctccgtccagcttttttccgttgctggcgaggaactgcattcctttggagggggagaggtgctctggtttttagaattttcagcttttctcctctgtttttttcccatctttgtggttttatctacctttggtctttgatgatggtgacgtgcagatggggttttggtgtggatgtcctttctgtttgttagttttccttctaacagtcaggaccctcagctgcaggtctgttggagtttgctggaggtccactccagaccctgtttgcctgggtatctgcagtggaggctgcagaacaccgaatattgctgaacagcaaatgttgctgcctgattgttcctctggaagcttcatctctgaggggtacctggccgtgtgaggtgtcagtctgcccctactggggggtgcctcccagttaggctacttgggggtgtgggacccacttgaggaggcagtctgtccattctcagatctcaaaatccatgctgggagaaccactgctctcttcaaagctgtcagacagggacatttaagtctgcagaggtttctgctgtcttttgtttgtctatgccctgcccccagaggtggcgtctacagaggcaggcaggcctccttgagctggggtgtgctctacccagttccagcttccccactgctttgtttacctactcaagcctcagcaatggtgggcgtccctcccccagccctgctgccttgcagtttgatctcagactgctgtgctagcaatgagcaaggctccgtgggcatggcaccctctaagccaggtgtgggatataatctcctggtgtgccatttgctaaaactgttggaaaagcacagtattagggtgggagtgacccaattttccagatgccatctgtcacagctttgcttggctatgaaagggaattccctgaccccttgcgcttcctgggtgaggcgatgcttcgccctgctttggctcacactcagtgggctgcacccactgtcctgcccccactgtctgacgagccccattgagatgaacccggtacctcagttggaaatgtagaaatcacccgtcttctgtgtcgctcatgctaggagctgtagactggagctgttcctattcagccatcttggaaacaccccccggaatataattctttactcctatatgggagagtaaaggatgtagtatagacattaataataatgtatatgcattccctgagaagtgaaatcaattgtaattataaatatattcaaaataaaaatcatcattggatgagtactttagattctttcctatgagtaaaatacctagatttttagacattgattttgacagtttaaaattatatcatattttttactattatcttggttcacagttatatttagaatgattatattgtggttccaatgagctgtgatagtgctggtttgcctttaagtgtcctcagagtaacataagacccattatacattaggatgaaaggcatttagatgggaaatatcatgtatattcccatgagatttttgaatcacccctggtaaaaaatgtgtgtattttgtaaaattaaatatacaattcaaaggaactcattgttttctctggaaaatgccctctggatttcaagcaagaaatttgcagaaaatattttttggataaagattgtgttaagtttgcatgatggataatataaattattctggaaatttactgtagataattaaaagtactttgtgtcataatagtgctgtatactgaggaaaataggcattctgttagaaactatactatactagtgaaactcaaccagccttgatttagtaactctctatagccagttaaaataagaaactgcaaacagaatgtgttaaataatcttattataaataactgaagtatgttatcaaccaatagaacccttattcactatagcaaaccatttgttgttttcagtatactctaatagaaatgataaactatgatgcctagcatgttttcccaaaaatgccataaggttacctgaatgtttttcttgtattgaaaatgatcagttatagctatacaaataaaatggagttataatctaaatttacagtatagaagtatgcaatattaaatgaataaatattgataatataaactgctttcagggtacccaaatatttttattaaatcccttaaaaatggacaaagtctttctatgcaatcaagtggcaaactgcttgtacataaacatacagaagtgaaaataatccagtgatctagctcagagtaaaagccaaagggcttaaaatgcttaataaagacttttggtttggctgctctctgactgtctgttcttattacctaatgtgctttcagtgcccacttatgctcttcctcaaatatacctgtacagtcttgcctcaggttatttgtatttactgcttcctctttgcaagtttcactatctcatctctaaggcaatgcgtaaatgtcactacctcagtaaggccttttctagccacccacttaaaattataaccctcttcttaatctccttgacctgtttttccccattgtactttctaccatattatttagttttattcatttctactttttaattgtctctcttccctccaaagtaagctttataaaggcagagagtttttgttcagcttgttaactgctgtatttccagtgtccagggtatgggaatgcctgataaatatttatcgaataagcctaaggccttatccatgtctgtttgctattgaagtagtcatataaatatttaattgactattggcaaagaaaacacaccacaatttgtggcaaattggatataaggaaagatgggaaaccctaagtgcgttttttatatatttagttgttctgataagataatggatgctatttaatgttcttatagtatgccaggaactatctgaagtgctgtacatgtatttatctaatttacaccttacaacaaccctgtgaaacaggtactattatcagctcctttacagttgaggaaactagtgatcaaataaagttgtcatgcaattaatgtgtaggaaggcaagacaggacagctgattctagaacctgtacttttaactaaaggctcatggttaaaatgctgttccattgatactttgagtagcttcatttgtatccttttaattcatttttattttggtaaaacaaaaaaaattgtaagtaatcatttctgtttaatcactgtggtttaaaatcacttaattacttttttccctttttgcagtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggtaagaaacaaacatttaaataatttatcttgcatttaaatgattttaaaaaagttttattttttaaattaacaaatagtaattgtgcatattcatgggtgtgtagtaatgttttgatacatataatgtatactgatcagatcaaagtagttaatatatccatcatctcaaacactgatcttttcaaaatgacgatttattaaaagtaaatattatacatttatttcaaataatacatttttgagtggtatacttgataattaattgtgaaagcaattgattcatattaaccataagaaaatttctgtcatttttctcctgggaaaggtgtatgaaattgtgccaaagtgctttcagtaaagtcgttaaacaatatgaattgctgtatccgcctaatttttataaaggaaagcagcatcaacaacagcaacaaaaagcaatgagattcaaaatagtgatttccctggtgttcacatttttacagtttatagaaatatgacatttaaagacagcaataattatttctatcatattgaattataatacttgaattgtacttaaatagaattatatttaaataaatgagggattcatgtatattttatttcaaaaatgtataagctagtttatatgggtgttatgtatgatgtttggtggttgaatattgacctgatcagagcttaattaatcttttgctattattacatagaatttttcaccatataacacattagcttttcattttaatagtagtatttatgtgacatctaattgtcaggaaatgttaacatcgcaaaatgctagttaagtttagaactatacctttcacattgttttaacaatgaaatacctataattttcgtgatgaaacatttttcactttttatgtaattcattttatgaaggcttatttacctaataagtatatacattcaaaaattttatataccccctaataaagagcatacgtttgattataattagatttaggactcataatcaaaacacaaatatagaaaaaaaattatttcatggtaaatagtaatataccggagatatttccctctcaatgataacttcttaagagggtgttttctacagcaccagcttgagtttattgatttctttgttgatgttatattcacattcattaaaaaggatgagaataaataagaaaaacatctgtatgcatataatggtcatggataatatatgtgaagttttaaaggttttttctgtttataaaacacttgggttcttgactctttagaagttcgctcaagctgccagtgatgattatgttttgtaactggagaatactaatatttgcatgagaagtcggtagtatatattttacaaagcatgaatcagctttcctgtgcttttaatcattaaagtatgtttcattcaagtttagtaatataggttatcaatatagtttatcaaaatttttattcacttataacaaggatttataatggagaaaaaccataaattatcctggagttaggatctaaagatattttacattggaaagtgcatgtattagtttgttctcatactgctataagaacttcctgagactgggtaatttatgaaggaaagagttttaaatggctcacacttccacaggcttaacaggaagcactactggaacacctcaggaaacttacaatcatggcagaaggcgaaggggaagcatgtatgccttaccctggcagcagaggagagagagagtgaaaggggaaagtgccacacactttcaaacaaccagatctcatgagaactcactatcatgagaacagcaaaaaggaagtccacccccatgattcaatcacttcccaccaggcccctcctccagaatttcaagatgagatttgggtggggacatagacacaccatatcagtgcactaaagaaaaatttatacatatgaataattatccagttaagtggagaagacaataagatctaaggataaaatgtattacacagagtaaccatgtagtgtttttggtacagacatgtaatatgtgtaataatcacatcagttttaccatattttaaattaggtagaaagccattacttggtaaaaaaaatacagttttttaaatatttgaagaattatttaatctaagaatttatgtgatttgctattactaaatatttgtatttctttatggcatttaccacagaattaaagtaaccaaccgtgatgtctagatttttttttacttaatatgcttgctgtgaaattttattcttatttatatgcctgcaaatttcttctatgatttggcaaagatagttttggacaaatgataagcagcatctgtttatctagagcttctacttgtgtgtttttatggcttgttatctttattatcctttatctgattgcagaaacatgagggagtcagtacagaacaattgttcatcaccttgtagtggatggcagaaattggaagatttaagtttgaattctatatctatggcttacaaacctcaaaatcaggtgttttttttaaatttataaagtagtggttataatcacctaaagatgaaatacatgtaaaactattaacaacaagcaaacatgcctgattctaattaaatataatgaattgctatttataaacaaaagaaatgtcagagtggatgtggagactacattattttaaagatatatatagtgcactaccaccagtgttcattttagagtacttacttttatgtgtgttcttgatgttgtgtgttgcccctttctttcctctgatgagaattttatcattgcttttattgccatctattcataacttttctcacaaaaaaaatctctgaattacatataatcaaaaggtcaaactaattcaaacttatatgaaaaaactgtagtacaagtagaaaagtgaccacatatataataggaaaagaaaaaatgagtatatcactatttttcttcttgtctattctgtgtaaacaattaattaatctacagtattgatttttttttagagacagggtcttattctgtcacccaggctggagtgcactggtgcgaccatagctcattccaatcttgaactcctaggttcaagcgatcctcctgccttagcctcccaaagtgctgtgattgcaggggtgagccactgcttccagccccaaactattgatatttttgagcatttactatttcttaatcactttcttaagtggtagagataaacataaataaggcatatgtttctgttattcattgctatgagacaaaacagcccaaaatgtattggcttaaaaccacaatgatttattatttttcagggctcagctagtagttctgcttaatgtacaataaacagccatcacttatgtagctgaattccactgggagcttgacttgagttggaatgtccaagatagcnccctcatcttccagggcctttctctatgtggcctctcatcatttagtatctatcccaagctttcctggagcgtagttgctggcttaagagggagtttattcacataaccatctgtaaaatgagtatccgaggagatagcacaagagtgaatacctgaaagtttatttataggggactgccaccatgacaatacattattttacagtcttctctctggattctcctgattaatgtcccttcgtcatgcacaaaatcccacaccctcccaaaggtttatcacattaggacatcatgttgaagtccaatatagcatgttgaaatcagttccagattcaaatgaagtttcgttgctaaaatccctgttgatctgcagaactaagaacctaaaaataagttatggttccttacacacacaacacacatggaacaggggcaggataattggaaaattttctcccattccgaaaggcagggaacacaacagtcactggtccattgtgattgtgaagtgcaactggtgttttcaaggtccctgactgcaggggcagagaatgttttctgattagagcccagttctgctccctgtgattggttccctgtgtcttttggctttcttactagtatcttgccgctgcactcttagtcattcactctgtttataagaattgcaactagcaacatgctagttgctagtttcaacagctgtctggaaacctctttaatttgatcaacaacgttatgaagtggtttttctctcttccaagctatcacaggcaggattattgccaattgctcagtacataacatgtgttgaccttttagtatccccattaacaatttctttactgatcttccagcctctactcacaatctccatgctattcttcagcttctaccatctgttcaatcccaaagcaaatatcacaagttttaactttttgttacggcaacacccagttatttgcttacagtttctacaatctggaaatctggatgaggttcactgggtcattcttttcctgtcttatctgaggtcactcatgcaactgcagttatttggaggtttaacagagctgcatgtctaagatggcttcactcatgtataatgcttcatctgttgtgtctgaggtaacgttgtgtactgtctaaatcctggtaacaattttagtatgttttatttcaggaaattattctagttttttttttctttctgatatattgattctaaggggttactcaccttagcattcaaggaattgtacattttgaccttgtcctgttcttttgtaacctcagcaaattctgtccactattctggtttttataatttttgaacaatccatgcgtttttgtatctcttaccttttttcatattttacctagctgcttttgtacccttttcttctttttctgtgatgaaattgtatttattcttcaagacctaacaccaatgtcatgcctctgggtcttcacaaagttattatcactctcctctgtgctacaatttgtgctaattatttgtgtatctgtttcactagggctgtcagataaaagaggtgtacttaaaaaatcacatgatgtgaatgatcacaaagcactgagtagttaaaagtgcagcctgttggtgctcctgtggaatgctctgtttcttctcatttctgtgaaataagtaaattttcttgagggagagttgtagtattttagatctggaaggccttagaaaatatttttatccatcattttatgaatcaggacactaaattactgagaacagaatttaatttcctggggccacacagtcgtaactaatgttagattgagaacaaagcccaaatatgtcttaatctggcctttatatgtttcccttccacctatcccccattcttttttttttttttaatgagacagagtctctctctgtcaccaggctagagtacagtggcgcgatcttgccgcactgcaacttccgcctcctgggttcaagcgattctcaagcctcagcctcctgagtaactgagatttgttggacaggatagtctcaatctcctgacctcctgatctgcctgcctcggcctcccaaactgctgggattacaggcatgagccactgctcctggcccccactattctttctcactctttcatttcctcattccagacatctatgccctcactttgaaatgcttcaatgtttgctgcctgccagacccaaagcacaggagccctaagtttctcattattaattaggcctgctctgccttctatttctcttcaggagtctaatgtggacactgctggagcaagatttaagcatcacttttgaaattcatgctgctgaggatgatgaaaatatatatagatatggattcatctggaactttgcttttagagatgataaacaggaaaaattacagtgaggctttagggatttttgtaatttgcttgaatgaatttgagacctcttggtcagctatgcaactaagacacaataagctgatttaaaatagaataaatctgtatctagtcatactccatatctactgaatgatgtatatttaaattgatgtatatttaaattgcatttaaataacttgttatgatattttatccaaaaagtcgtactactgaatgtttgaatttgtgattcctttttgcataatattgttaaggcttacctgtatccaaattctagaagcacaaaagagggcagtagacttttactcttgctgtatgaaccaggcttaaatagatagaaagattatattaagcatgtttgctaaaatttaaaagcaaacacgaataatttgggttgctttattatacatagtaagcagtattttagtcctctttcaaatctcagctgatatttcataacttttaattttatttcatagattcataattaagactgtcatattggacatgttgatgttacagatttaacattgttttaatttattctacttaatgtcagacttttctaaggttttgaatttaaaaataacattgatttgcaaagtattatgctaatttacatcaaatggtctttcagtttatatgtctaggactattttagcactatggaagaaataattggaaacaacatgcaaaattgaatgcaatttttgtttagttatacgagttctgaagtagcatgaatccctaataagctcctcttaaacattaatttaggatgaatctcattaaggtagtggtacttgtacttagagatattagtttgtgtttaaaattttagacctgctgagaatgtgtgtgtgtatgtgtgtgtgtgtgtgtatatatatatatatatagagagagagagagagagagagagagagagagagagagagcgagctatatatatacctacaggctgagaatatgtgtgtgtatatatatatatatatatagagagagagagagctatatatacctacaggcttaaagaaggtattattgctatatatatatatgtatcactcagtataacttaactaaatactatttgtctatgaaaattaaaattgtgaaacactaggcataattaaaaacctttcttctgcctagaaatatgctttaaaactttttttctagtagtgcattaaaattcagaaggaaaggatgctggcaattctcggaccattgcattattgttcacgaaggtaaatgggatatacagggcctttagtgacattgtattgatttgatctcttgaagagtgttgttattaaggcttcatggcgcaatcctctgctgcagttcagaaacatttatgctgtgtgtttatgatcttctgtctaatcatgttatcagagatgactgtgcaagcagagagcataaagaaatatgagataccaggatttgctggcattaaataagggagtttgaggatatgatgaaaagctgaaaggtaagattgggatcagaaaaaaagggcagatttattggctcaggtagtattttcactttctaaaggttctcacacactgaatataaactcttatattataaccttcaattccaaacaaagcagctttttcatgaagcaattccagactttcatctatcttgaaaagaatgtgaaatcaagaatcctgagaagtctaaaaatagaaggtattatttccaagcaagaaaggataaagttgaataattacaggcatacctcggacacatttcaggttcagttccagaccacagcaataaagcaaatatcgcagtaatgcaagtcacatgaatattttgatttcccagtgaatataaaagttatatttacactattattgtctattaggtttacaatagcattgtatctaaaaacaatgtacatgcttaatttaaaaacaccttattgctaaaaaattgctaacaatcatctgagccttcagcaagtcataatcattttgctggtggagaatcttgactcgatattgatggttgctgacagattagggtggcagttgctgaaggttttggtacctgtgtcaatttcttaagataacacaacaatgaagttagccacttcagttgactctttcatgaaagatgtctctgtagcatgctaggtgtttaatatcattttacccagagtagaactttcaaaattggagtcagtcctctcaaaccctgctgctgctttatcaactaagttgaaataatattgtaaacattttgctgtcatttcagcaatattcacagtgtctttactggaattagattctgtctcaagaaaccactttctttgctcatccatgaagggcaactcctgatgttttcaagttttatcatgacattgcagcaattcattcatatcttgtctctacttctgctttttctcttgctatatccacaacatctgcagttattttctgcaacgtcatccttgagggtaggtgttaatttcttcaaaactcctgtgattgttgattttttttacctcctcccatgaatcacagatgttcttaatggtatctagagtgttgagttcttggcagagtattttcagtttactttgccggatccattggaggaatcactatggcagctatagccttagaaaatatatttcttaagccataagacttgaaagttgacatttctctgtgattgatggactgcagaatggatgttgtgctagcagatatgaaagcaacattactcttcctgtgtatctccatcagagcttttaggtgaccaggtgcatcatcagtgatcagtactattttgaaagcaatcttattttctgagcagtaggtctcaacagcaggcttaaaattctccataaaccatgctgtgaacagatgtactgtcatcaacctttgttgttccatttatagagcatgggcagagtagatttatcataattcttactaggtttaggattttcagaatgtaaatgggcattgacttccacttaaactcacaagctgcattaggtcctaacaagagatccagcctgtcctttgaagctttgatgccaggcaatgacttctcctttctagttacaaaaggattgttacatctacattgaaaccctaaatgtggccaccttcctcaatgattttagctaggtcttctggataacttactgcagcttctacatcatcagcacctgctgctttaccttgcattattgtcttatagagatggcttttgtccttaaaccttgtgaaccaactgctgttggcttccaatttttattttgcagcttcctcccctcactcagccttcatggaatttttaattccatgttagggtcttattctggattaggctgtggcttaagggaatgttatggctgctttgaccttctgtccagatcactaaaactccttctcaacaataaggctgctttgctttgttattcatgtgttcactggagtagtactttttattccttgaataacttgttatttgcaatcacaacttggctaactctggggcaagaagcttagttttcacctatctcagctttcaaggccttcctcactaagtttaatcatttgtagcttttgattttaagtaagagaagtgtatctcttcttttcacttgaccatttagaggtcattgtagggttattggcttaatttcaatattgccgtgtctcagagacccaaggagacagagagagaagggagaatggccagtgagtggagcagctggaacacaccatatttatttattaagttttctggcttatgtgagtatggtttatggtacacccccaaaatagggtagggacattgaaaatcaccaatcatacaaaagtaacataaaaaatcattgataatatctgttatggtgacctatgatataggatctacattacatgtaataaggatgtaaaagtttgaaatattgctggaattaccaaaattaccaaaatgtgatatggagacataaaatgagcacacacttttggaaaaatggcaccaatagccttgcttgatgcaaggttgccacaaaccttctatgtttagaaaatgcaatatctgcaaattgcaataaagttcagtaaagcaagacatgcttgtacattatagtttgttctttgtcatgatttataaaataggttaaagggcaaacctacttgaaattataattttagcaaattattttacacatatttaataccaagtttagtccatattttattctgttaactttaagactatattgaagtcatattcctgtagggctatagggctgtccttaatttaaaaagtcaaatttatgtaaataaatttacacacatttctatgggagcataaatttattcactatctctgtactctttccagacatgacttaccatgttacccatgtcacccactgaaatggctccttttcatgtgaattctgcctagaattttagttctaccttttaaacaagtgaaattaatatgtatatatatgcaatagttggaaacatcaatatatagtaacagtttttgtacctttcattttgtctatcattatctcctttcttttgggttcaaaagtatgtcttttggtagttcttttgataaagttctatgagcagttaagatttttatttaatggatatttaagaatagctttattttttctctccctcttcaatgattgtttatttagatgtagaatacaagatgatgatgatttttcttcaacattctgaaaatgttatttccccgtctatgagaatctattattgctaatgatctgccgacaatttaattgtcatttcttgggagattatgtataggttctgtatttttggtttttagttatatctgatgtgtctgggtgtggatttatttttttcctgcttttcattctgtgtttttaacctgagaaagagagagacagagaaagagagagagagaaagattgctttcttttattctgtatttctagaatttttattaaatatgtttgttggaaactttcaatttatcctgtctttgaaataatttaaatctcagcaataatttccaggtttagaattttcactttgactatgcctagttaagagtttacctcatctgttgagatatctttatcttcactagttttagttgttaactttttcgttcttactttttgtttcatttctgcctactttgttacataattctcttcctcttttatggttattttattctggatatattttaaggtcccattctaattgatttggatcaaattaatctgattatttagtgtgttgcctacatttctaagcatttgggtctatcatgtactttggaattgtagtaggctgactttctggaaatttcatattttcctgtctgatttctgttactgtgtcatcagtttttttatttgaaaagtttgtgattataccaacccagttccctaggctttaaatagagaaaatttaaggggcctaataaatttcccaaagaattcaagttagtaatcctggttgacaggtagttctgcttcatgcagtaattcagggatccagacttcttgcctttagtaaagcagacatctcttaaagccttgtagttgtctgtatccagctcagagattagagcagacttatgtccttcttagtcaactcatatttgaagagtcacatatcatctcctatcacataccaacaatgactacagtatatggctacacataacacaaatagagggagttgctattaaatgttgttcttagctcagtagtcactttccacaaacaattctctgccatggaagaggaagaccaaatttttctagacatttggtcatctctgcaacagtctgtcacttcaccaacaaaatatagatattgatcctcatgtgtctgataatgcacagttttctccatcaggctcaaataatccctgaacccctaagatgaataagcataacacaggctgtcagagctgattagccaccagtaactacatcagaaatggtcatggatgacagaagaatctcacagatagtggagttgaaggtcattgagaacaatgacacacaccatttaatcagtgtccatatcttttggagagcttcatattacctacccaaaaagattttcctatttcttttccttccagctctcaacccagctaattattgactgaacccatctgttcctggaaatattagtatattgttaaatgtgtcaagtagcaaccaagacaaagaaatcatagctgttggccggccttccaagttattgcatattaaaaagttataccaaggctattactgttgtgtaatatagattttcatctatccaaagcctcctgttacacatcacctgtcccctgattgctaagttaatgtcacttattttagagttttgttatgggtctattccaattaccatgtgtgtatgtataaacacacacacacacacacacacacacacacatatatatagccatatatagccactcatatatagccatatatatgtatacacacacgtgtgctttttttatatattttatatatatatatgtatatgttggagttaaaatattgtttaaaagctgaggtaacagacaaaaatttcaaagtccagagccttacaatgtagaagttagtttttcattcacgttacagtctaaggtttgcttgttgttgagggctttccatcatacacaaaataagggaactgtgcattttctttctctagctctgttatcacctgtggatttgttgttatctgtatccaatgagtagagcatatatgtatccaagaaagagagcatatatagtatacaagtgcctcttaaaaaacttgccatagaaatgacatgtatgtaatcaacaaggtaaaggtttttagtgtaaggttaaatattgtcatgtcaagtaattacggtaatcaggatttttcttttttgaacagtaggcaggtagtaagctaagttatatatatatatatagtgtatatatcttagcaatgtaaattaaatttggggcctgatttttagatttttagctgtgtcttatctggctacaaaaggcaagacatttctttacagccttcctaaatctgtggttctctgaggatattttgatctgaaagattaaagcccaaagcttcttactttttttttctgtaaactctccagcccagtcagaaattgatatatatatatatgcatgtgtgttcgtatatatgtgtgtgtgtgtttcataaaaccagatataaaccgaactaagtatgccaaattaaagttatttttataaattcaaaccttattctctttatatagaaataaatagtattcaactattttgaagaaaatgtgattattttcatatagaaactaaaaatagcaacagggaacatttgtggtaaaccttctgcaataacagttcatgcattatttgaagaataatgtattttacataaatacattcaaattgtttttaagatatcttgttgtctcttgtaagaaaatcatcccagatgtggacataaactcggatataacttatggtgatattggaggacattcgtaatatttttgagtcctttgagacaatagctttacaaaaatttaagaaattactggtgttctcagttattcatgtggcctttttaggaaataatactttttgtactcagttttttccttcctttggcatgtgatactatcaattgaaaatttgacttttataaatagttctccattatgatattatgaaaacttctggtaagttatcgttttcaatctgaaattactacaaactatttttttagaatgagtatcaataaataaatcaatattattactggaaatggtagtctcagttttacagggaactgtagagtagtggtaaatttaaagagatggagatgttcagtttcaagtcactgtatacaaggactatcagcatgaaaagaagcatgctgtaccaaaaatagatgggaacattgagaccgtaaaaacaagctctgcttttctgcagcaatggacagaaaaaagcatgatttattcccattattggacagtatcaaaagtgactgccataaaaagtgatgaaaacctcttgaaagatggaaacactgttctgtggacagagataactattgtcttggatagaattctttaactaggattatggtatatttggtcttttttaaaataaatgactaatattctcatttcttggttttatttctattcttttttaaaagtaaactactcttcaggattggttattttttaccgcctcgtaattaaggagcctatattctttatgtttacaattaaatatttttaataaaattaaatgtaaaaattgtgttaattgaagattctctattaatttaataattgcattatgaccaggaggactttcctcttgaagcctaattttatgtgggtgcatttatatatagattgctattatgaactaattcactatggagatgaagtattaatattatatgtatataattttttaaattagcctataaaataaatagcataccttacttatgtaaataatttttattcatgagggttgttttttttttcagaaattctctttcatctattgaggtgaccataaaatttttctatttatctatcatgagatatgttataataatatatttccttagatgaccaatctgtggtttaatgaagttaagttatttgaccttgatggattgttaccttaatgttgaatattatgtattttctttaatttattaaaaactgggatgaggagattctgttgaatgctatgaagtataaatatgttttgagtgacataaagaatataatatatatactatgttcttggataggagttgtaaagaagtcagactcaaaattcttactgtttttgctactttgaattcagcaaaaacggtgctcatttttgtataaaataacaaatgcattgcaatataaaggaatatttaaaaagaacagtaaactagaagagtattcctggcagatattaaaatgtgtttaaaggactatatttaaaatatatagtattaacttccaaagataaatattcatcaatgttaccaagaaaagagtttaaaaatagactaaattacatgaagtagtaaaacaatggtgaaattgactttattaattaatgggaagaatagacagattgtttaatgccatggttgttatgttgtaggggttgatattggggaggagaaacaatgatcatttggacatagggtgagtattgcaatttcttttcttttttttcttttgagacagagtttcactcttgtcgcccaggctggagtgcaatggtgaaatctcagttcactgcaacctctgcctcctgggttcaagagattctgctgcctcatccacccaagtagctgggattacaggcgcacaccaccatgcccagctaatttttgtatttttagtagagatggggttttgccatattggccaggctggtctcgaactcctgacctcaggtgatcctcccaccttggcctcccaaagtgctgggattataggccaatttcttaactaagccccagaagagtcactctcacaattaaatgtgagttgaatgttggaaattagcagccatcgtaccttagtggagagatctatttggggaaaagagaattcccacagagtttcttgttgctttaaaatgaagcctaaggcaaagttataataaaatgaggctgacttgtaggatacaaattaggattttcatgaaaatttataactgtagtgaagcaataactttttaaaaatgatttgctttcctatttctttttttctttatttcttcttcaaaaagaaaaggggggataaatgtgcagaacacgcagatttgttacataggtatatttgtgccatggtggtttgctgcccctattgacccgtcctctaaattccttcccctcacccccccaccccacaacaggcccncagtgtgtgatgttcccctccctgtgtccacgtgttcttaatggatgttcaacccccacttatgagtgagaacatgcagtgtttggttttctgttcctgtgttagtttgctgaggatgagggcttccagcttcattggtgtccctgcaaaggacatggtctcattcctttttatggctgcatagtattccatggtgtatatagataccacgtttctgttatccagtctaacattgatgggcatttggtttggttccatgtctttgctattgtaaatagtgctgcaataaacatatgcatgcatgtgtctttacagtagaatgattcatattcccgtggttatatacccagtaatggcattactgagtcaaatggtatttctggttctagatccttgaggaatcactatatgtcttccataatggttgaactaatttacattcacaccaacgatgtaaaagcattcctatttctccacagcctcaccagcaactattgtttcttgactttttaataatcaccattctgactggcatgataaggtgtcttattgtggttttgatgtacatttctctgataatcaatgctgttgagctttttttcatatttttattgaccacatacatttcttcttttgagaagtgtctatgtcctatgcccactttttgatggggttgtttgtctttttcttgtaaatatgtttaagttccttttaaagtctggatattagacatttgtcagatgagtaaactgccaaaattttctcccattctgtaggtttcccattcactctgatgatagttaattttgctgttcagaagctctttagactaattagatcccatttatcaattatggcttttgttgcagttgcttttggcatttttgtcatgaagtctttgcccatgcctatgtcctgaatggtattgcctaggttttcttatagggtttttatggtttttggttttacatttaagtatttaatctatcttgagttaatttttgtataagctataaggaaagtgtccagtttttccagcaccatttaatgaataggagatcctttccccattgcttgtttttgtcaggtttgtcaaggatcagatggttgtagatgtgtggtgttatttctgaggtctctgttctgatcctttggtctatatgtctgttttggcatcagtaccatgcggttttggttactgtagtcttgtagtacagtttgatatcaggtagtgtgatgcctccagctttgttctttttgcttaggattgtcttggctatgccagatcttctttgattccatatgaaatttaaaatagcttttttttctaattttgtgaagaatgtcaatggtagtctgatgggaatagcattgaatctataaattactttgagcagtatggccattttcacattattgaatcttcgtatccatgaggatggaatgttttcccatttgtttatgttctctcttatttccttgagcagtggtttgtagttctccttgaagaggtccttcatatcccttgttagctgtattcctaggtatattattctctttgtagcaattgtgaatgggagttcattcatgatttgactctccgcttgcctattgttgatgtaaaggaatgcttgtgagttttgcacattgattttatattctgcgactttgctggagttgcttatcagttcaagaggtttttgggctgaaatgatggagttttctaaatataaaatcatgtcgtctacaaacagagacagcttgacttcctcccttcctatttgaataccctttgtttctttcccttacctgattgccctggccagaacttccaatactatgttgaataggcgtggtaagagagggcatccttgtcttgtgccagttttcaaagggaatgcttccagcttttgcccattcaatatgataatggctatgagtttgtcataaatagctcttattattttgagatgtgtgccatcaatacctagtttattaagagtttttaacatgaagggatattgaattttaccaaaggccttttctgcatctattgagataatcatgtgatttttgtctttggttctatttatgtgatagattacatttatcgatttgggtatgttgaaccagccttgcatcccagggatgaagctgatttgatcatgatggatgagtttgttgatgtgctgctggattcggtttgccagtattttattgaggatttttgcatcaatgttcatcagggatattggcctgaagttttctctttttgttgtgtctcttcccagttttggtatcaggatgatgttggcttcataaaatgagttatggaggagttcctccttttcaattgtttggaataatttcagaaggaatggtcccagctcctctttgtatttctggtagagttcagctgtgaatccatctagtcctgggctttttttggttggtaggctattaattactgcctcaatttaagagcttgttattagtctattcagggattcaacttcttcctggtagggtgtatgcgtccaggaagttatccatttctactagattttctagtttatttgcatagagatgtttatagtattctccaatggtggtttgtatttctgtggggtcagtggtgatatcccctgtatcattttttattgtgtccatttgattcttctctgtcttcttctttgctagtctggctagcagtctattttttttttaattttttcaaaaaaacagctcctggattcgttgattttttggaatgttgttcttgtctctatctctttcagttcttctctggtcttagttatttcttgtcttctgttagcctttggattaatttgctcttgcctctctagctcttttaattttgattttagggtgttgattcaagatctttctagctttctgatgtgggcatttagtgctataaatttccctcttaacactgctttagctgtgtcccagagattctggtatgtcatctctttgttctcattgatttcaaagaacttgatttctgccttaatttcatcatttacccaggagtcattcaggagcaggttgttcaatttccattaaattgtgtggttttgagtgggtttcttaatcctgagttctaatttgattgcactgtgtttggagagactgtttgttattatttcagttcttttgcttttgctgaggagtgttttacttccaattatgtggtcgattttagaataagtgccatgtggcactgagaagaatatatattctgttgttttggggtggagagttctgtagacgtctattaggtccacttgatccagagctgagttcaagtcctaaatatccttgttaattttctgtcttgttcatctgtctagtactgagagtggggtattaaagttttccactgttattgcatgggagtctaggtgtctttgtaggtgtctaagaacttgtcttatgaatctgtgccctcctgtattggttgcatatatattcagaatagttagctcttcttgttgaattattgcctttaccattatgtgatgcccttccttgtcttttttgatctctgttggtttaaagtctgttttatcagagattaggattgcggtccctgcttttttttttttctttccatttgcttggtaaattttcctccatccctttattttgagcctgtgtgtgtctttgcacacaagatgggtctcctgaatacagaacaccgatgggtcttgactccttatccaaatcaccagtctgtatcttttaattggggcatttagcccatttacatttaaggttagtattatgtgtgaatttgatcctgtcatcatgatgctatttggttattttgcatactagttgatgtagtttcttcacagtgtctttggtctttatattttggtatgtttttgcagtggcaggtaccagtttttcctttccatatttagtgcttctttcaggagctcttgcagggcagacctggtggtaatgaaatccctgagcatttgtttgtctgtaaaggattttatttctcctttgcttaagaaacttagtttggctggatattaaattcctcgttgaaaattcttttctttaagaatgttgaatattggcctcccactctcttcttgcttgtagggtttctgctgagaagtctgctgttagtctgatgggcttccctttgtaggtaacctggcctttctccctggctgcccttaacagttttttcttcatttcgaccttggagaatctgatgattatgtgtcttgcagattatgttcttgtggagtatcttaatggtgttctctatactttctgaatttgcatgttggtctgtcttgctaggttgaggaagtcctcctggataatatcctgaagtgtgttttccagctcatttccattctccctgtctccttctggtactccaatcaatcataggttcggtctttttatgaagtcacatgttttttggaggctttgttcattatttttcattcttttttctctattcttgtctgcatgtcttatttcagtaaggtggtcttcaaactctgataacctttcttccgctgggtcgatttggctgttgatacttgtgtatgcttcatgaagttcttgtgctgtgtttttcagccccatcaggttgttttatgttcaagctatataaactggttattgtagttagcagttcctctaaccttttatcaaggttcttcactttttgagttgggttagaacatgctcttttagctcatcatagttttttattacccatctcctaaagccctacttctgtcaatttatccatcttatcctccatctagttctgtgcccttgatggagagatgctgtaatcatttggttgagaagcaggcactctggccttttgggttttcagcattttttcattgattctcatctatgtgaatttgtgtagtttcggcctttgaggctgctgacccttggatgggttttttatgggggcccttttgttgttgttgttgatgatgatgatgctgttgttgtccctttctgcttgtttggttttctttcaatagtcaggtccctcttctgtagggctactgcagtttgttgggggtttacttcatgccttattcatctgattcgcccccctgcctggagataccattcatggaggctggagagcagcaaagatgggtgccttctccttcttttggcacctctgaccttgaaggtcaccaacctgatatcagtaggatcactcctgtatagggtgtctgacaacccagttgagtgtcacggggagcaggactcatttagtgaagcactttgtcccttggtggagaaggtgtgttattgctggagggaaacccactagtactgggctgcctggattcctcagaactaccaagaggaaaggctaagtctgctgctctacagagaccgttggccactccttcccctaggggctaaggcccagggagatccaaattctgtccctgatcctctggctggagttactggagatcctgcagggaagtcctgcccactgaggaaggatgggtccgggttagaccttaagaggcattctggctgcatactgccacagccagtattttgggctgtggggacaagtcttgggaccaaaccatccagcctccctggctctggcaggggaaaagagcagcctagagctatagaaatgggtgctgcccttcccccatccagggagcttagtgtggtaggcagttgccagtcccactgctggttgcttcctctctgccaaagagctcaaagggcttagacagcaggcagctgcgctggtgctggttgcccctcccccaaggagtttcgttggcttaagcagattccagctgagaggctgtaagaatctgcacattccagggttgggaagctacgccccggtgtcatggtttcatgagtgggatctttcgatccatgggttgcacagttccacagaaaaagcagtttccctggctgggtagcatgctcactcaccacctcacttggctggagggaacagactccccttcccttgtggctctcaggtaggccaccacaccactctgctcttccttctctccatgggtcatgctagccttctagtcaattttgatgagagaacctggttaccttggttgccgttgaaggattcacatgcttatcattgtttttttttttttgataggagcctccaaaggccgctgcttctagttggccatcttggccccaccccgaaacagtaacctttgaagaataaaagaaaaagcaaaagagtagcattactaaaatattaaacggttacatttacagccaaaatttgttttgtttttattttggtgggttttcattaagaagacattgtgttggtatgaaatatgggttctggtcaatcaaagggaaattctagattatttgtaatatcatgtaataacttgtagcagaaattggcagaccatagcctgattgccaaccccaacccatttttataaataaagtgttttggaatacagccaaagttattcatttacatattatctgtgtctgctttcaagctatagtagtagggttgagtagctgtgtcagacaccatatggcctacaaagcttaaaatatttactatctagtcatttatgggtaatatttgcatacctctgccctataagcaaattaatgcatatcttggaaatataaagttatcaaacttgttattttttagccatatattagtgggtagcatttttgtaattaaacatagaataaaacctctactggaaatatttccctcaaaaggtaaccatctttttattcagtcatttatcttatttaaaaaaattatttttatttatttatttatttattttgaggcagtgtctcactctgttgcccaggctggagtgcggtagcgatctcggcacactgcaacctccacctcccgggttcaagtgattcttgtgcctcagcctccaagtagctgggactacaggcacatgccaccatgctcagttatttatcaaagcatctatgctaaggaatatacattcaaaagctttcaatagaggatttcatatttatttgtcttcggaaagaatttggtttttattaaaatgcagaaatatctgagagagattgttagtaaaaaatgtagggatgtgtatgtggtgcgtgtgtgtgtgtgtattttcataaaggagtgttagtcaagtgcttgctacttacttgtaaccaaactaaggtttggatgcatgccacctgaaaagacaaacacataagaagtaaggtttcatagaaggaaagcagctttattcaagtggtgacaccttgggagatggccagactcaagtctgaaaaatccatcttaaattctcagtctgtataaggggattttaagggggaaggttgcatggaaactgtacaggagtgtgcatggtgcaggtctgcttgttgttttccactgctagtttgagtaacagactatccagaggcctggttggcatcatctcagtagaggtcaggttagggattaactgcacaactgtttcatcttgaaaggaagaaaattgaaactgccatctcctgcctcatgcctggattgttgtaagattagcctttggacatttcaagcaaacaggtagttacatatatgtgtatcaagaaacaaacaagggagggattatctttagagtaagctagcaaactggctatactggttacattaggagacatttctcaaggactctttttaataccagctaattctctcattttgcattttgaccaattgccatgacagacactaaaaatgtatttgtgatttgtttaacttctatttctttttcaacttttattttagatttaagggatatgtttacatgctggttttgtgggtatattgtgtgacactaaggtttctgatacaaatgatcccatcacccaggtagtgagcataatactcaatagtttttcaacccttatcccccacccggctccttcctctagtagttttcagtgtccattgttgccatctttatatacatgagtacctaagatttaactcccacttataagtgaggacatacttacttataagtaagtatggttttctgtttgtgcattaatttacttgggataatggcttgctgccttatccatgttgcagcgaagaacattatttctttctcttttttgtggctgcatagtactccatggtacatatataccatattttctttatctgctacacaattggtgggcacctaggttgattcaatgtgtttgatattgtaaataatgctgtgatgaacttacaagtgcatgtctttttggtagagtgattgatttaaaaatatatatgtacccagtaatgggattgttggatcaaatggtagttttgttttaagttctttgagaaacctacaaactgctttccatggtggctgaactaatttacattcccaaacagtatataagttttcccttttctttgcagcctcaccagcatctgtttttgcttttttttttgagacagggtctgactctgtcacccaggctggagtgcattggcatgatcacagctcacagtagcattgacatctccgactctgggctcagatgatcctcccatctcagcctccatggtagctggaactacaagtgtgtgccacctgcccaactaattatgtatattcatatatatatgtatgtatattcatatatatttttatatatgaatatattataaaactagaatatatatacataaaatttatatatgtgtgtgtgtgtgtgtgtgtgtatatatatatatatgtatttttttttttttttaaagaaactgggttttgtcttgttgcccaggcttgtctcaaactcctgggcttaagcaatctgcccccctcggcctctcaagtactgggattacaggtatgagccaccacactggacttactatttttttgactttttaataatagcccttctgactgatttcaaatggtatctcgttattgtttttatttacatttctctcacgattagtgatgtggaacacttttcatatgtttcttggctacttgtcttttgagaagtatctgttagtatatttgcccactttactgggcttgtttatttatttatttacacttgttgaattgttttagttctttacagattctgaatattagacctttttcagatgcatagtttgcaaatatactctcccattctgtaggttgtctgtttaccctgttgataatttcttttgctgtgtagaagctctttaacttaattaggcctcacttgtcaatttttgtttttgttacaattgcttttgaggacttagtcataaattctttctcaagtccagtattcagaatggtatttcttagattttcttctacgattgttgtagtgtgaggtcttatataaatgtgcttgtttaaaaaagtgtgagttaatgatttatattctttgtgtaaaagtatacacagcatcagattataaataaaatttaaattatattttacttagaaatgataaaaaaaaagattttctgtgaaccatagactaaatttccagtaggttctcatgtttttctccctacatctatattatattctgcttttagcaatcctagatatatgtttattaaggtgtgatggaggcctaatatttactgtgtacccactacgtcctgaaaaaccatgaattgccattaattatcacagtctgtgtcaaacaatacataaatcccttggaacacagtactatttataattgtgctgttgcttatatgaagggatgtacactcacatggaggccataaatgtatatacactttgtatacttagcttattatgttatgaaatatgtttaaaatggatgttctttgaaattttcccaaaattgataatcttgaataaaaactttttatgaagatatttctaaaataagtaatatatcttatctgcttaagatataaacaagaacctttgttttcaaccaaaataatagttatattcaaattatgaagcatgtttttgcataggagttttatgtttttgtttttggcatgggtcttcagtaatgcctcctgcaaacttatcattattgtatattgtcattatcttatttttgtacttctctttctctctgccctctccaccacccaatctgtcttatttttgccctttaaagaactgaatttatgctgaatggtgaatattttatcattatatttatttatatttgaactttcttatactgtgtacttgattaaactttcctgtaaaatgtgactatattttcccattttatacctcttgtcttttaagatagagataaacagatagagaaagagataaaaagagcgatagataggtcaatagatatccaactcattcattctaattcatcaaaagtaaggatttggaaaaattatttaccattaaatattaaaatgatttttcagaattttacttccttccttcctttccgtcctttctcctgccttccctccttccctcccttcctccctacctctctccctccctcccttccttcatttctccctttttctttcctctctcccttcacctccttccttctttccctcccaccttccttcttcctttcctttcctttccttctttccttcctttctgttatggcataaatatgcaaaacttatttggaggaaatggagaaaattattgcttaatacatctcttcttccattaaagttctttctgtatatgtatacgtggcattcttaggaaaggactgcgatgttgaaacataaattagcaatgcttgcagaatttaatgatctgcctgtgaatacaaaatatatcatataataattctgtacctactaatgaaacattgaagagtccagcattgcacgtggaatgtttctttaaatgaatattacttcaaagggatgatgatcaaagtatttaagaattcctaaaggatcagaaattcttttttgagataattttccttaacataacaatgcatgtttatttgctgtctgatggccatggagtagtggtatgttatgaaaaaatgtcttaaatttgctgtgacagcctcttttcccagaagattagcatatcaaggtttgtcttctatatatatttgtaagctagataaaagtgttaattctaattgaaatggttcctttagtagatttaatgaaccctccaccaacaagtaaattaaactgaaaattattgacacaagttttatcattggagaagaaaataattaccaaaatcattgtctcctcttgatcaaatttaactcccttgtcatagaaaattgtaaattgaaattaggagtaaaggcctgtgtgaaaaaagaagtaacattatacaataaagtattgtagaagaaaatcttactagttgctgaaaccttatactgtaagaaaaagcaagggaaatagatgttcaattggtaaaatcagtataaagtaacaacttaaaatgattttgtccagctctgtcattaagtagggcctataagcagtagtggaactttaccccagaaacataggtgtgtgttttcttttccagaaagatccaggagtgtttgggttatagccagtttcatttcttaatacaggaaaattatgagggtctgtctggactgtcttttcaatgtcaaactaaatatgcttttagaataaaagaataagtgttgtaaggggaaaaacccattaaaactattcccatctccaattttaatgttaaaaagaatatatatacatgattacttaaaataaattatgtttgggaaaggctctgagttcacagtgataatcaaaagggacacattaaaatacaaatataacagagtggaaggggatcaggagaggagtgaacactgctggtgagaacagcactggagagcgtgattccacatccagaagacgcagctccccacatatttgacaaggctcccagactctgagagcgttatcaagttcattgggctcacagaaacagataatttatttaaaaattagaaacaaaaacttcactaatagctgacgatctctggatagtgactttttttaattatgagaaaacatttaaggaaaatcagtgtttttacatccatttcagaattgctttggctatttgtttattgtctttccttgtttacttgcactatttggctaacctgcagtttgttcattcttccattcttcattcttcctgaaaaaaaaaaaaaaatcaacagcttcattaatcttaaaatataaaaagaaaatcccaaagtggtgaatgaaacattgaagatatgtgtcttaccaaagcagcttgctgtaggtatgggctgcattttttgtttgatactttgtatattcagatagttatttatatagaagttaaattccacaagtttctggtaatgactttaaacaattaatgtatcttccaacaataaaatcaacacttctgaatttgaatgaaaaaaatctgaatttttggcaatgattcaaagctttttctctgaatttcaaaagttttgacagaatctccactttaaattccctcccactctgttaaatttaactataataatgtgaacattccaatttcagaaaaaaagtaaattaaatataaaaagttctaataagaaatagttatttacattataaattatgtatttactttaaaatgcatacaattcagttaaaatcaagagaccaaatgagacttatttataatagctctattaagtaataatgacataaaataaactgtattttaaagtgtgcagtttggtaagttttgacgtatgtctagagccgtgaacccatcatcacaactaagacaataagcatatctttcattcccaaatttttccttacgcacctatgtaattcctctctcctttcccttagtacagccaataactatggctctatacacttgtctctttatgttggttaacgtgttctagaattatcacaggcatctgcagtatccactcttttgcctgctctttaattcaatatgattattttgccatttgttcatgtaactggatgtatcagtactcagtattaaaagttcattacttttaatgctgagtagtagagcattgtttggatataccactagttgtttatccattcatttgctgatggacattttggtagtatcttgtttgtggctgttacaaacaaatttgttaagaacatttatagagggacagagcaagatggccaaatagaagcctccaatcatcccactaccacaaggacaccaatttaacaactatctacccaaaataagcaccttcataagaaccaaaaatcaggtgagcattcacagtacctagacttaatttcatattactgaaagaggcactggaagagggtaggatatagtcctgacttactgatggcacacctcttccattccctggaagtggctgtgtggctcagagtgagaatctgtgtgtctgggagaggggcagtgcagcaactgtgaggcattgcattgaactcagtagtcctttgtaatagcagaaagcaaaaccaggctgaacacagctgatgccaaccctcagaaggagtatttaaatcagcctcagctagaagggaattgtccatcccggcagtcaaaaaattgagttctggcaagtctcacccgcacatgctaaagtgcttgggggccccaaataaacgggaaaggcagtctaggccccaatgactgaaacttctaggtgaatctagggctgaactggactcacagccagtggacttatggggcaagtgacctacacagacaccatttagggtagtgaaggaaatgctcatgctgctagatgtattggagctccattgtacgttatttgtttcttttctcttgctgcttttaggatcctttatccttgatctttgggggttcaattgttaaatgcctttaggtggttgtctttgggttaaatctgcttggtgttctataactttattgtatttggatatggacatctttttctaggttggggatgttctttgttgttatccctttgaataaactttctatgcctatctttttctctacctcttctttaaggcaagtaactcttagatttattcttctgaggctattttctagatcctgtaggcatgctttactgtttcttattctttttttttttgtctcctctatgtattttcacatagcctaccttcaacctcactaatccttcttctgcttgatcaaacctgctattgaaagactctgatacattcttcatttgtccatcacatttttcagctccagaatttctgcttgattcttttaaattacttcaatctacttgttaaatttacctgatagaattctgaatttcttctctttttctgtctcccatttattttggggtctttatttgcatgcatttttaccgctttatgtgtagggaccagccccacagggtcggtgggtctctccccatgtgcggagacgagagagtgtagaaataaagacacaagacaaagagataaaaggaaagacagctgggcccgggagaccactaccaccaagtcgcagagaccagtagtggccccaaatgccaggctgcactgatatttattggatacaagacaaaggggcaggataaggagagtgagccatctccaatgataggtaaggccacgtgggtcacgtgtccactggccatagggcccttccctgcctggcagctgaggcagagagggagaggagacaaagagagaaacaacttacaccattattagagacttttagtactttcactaatttgctactgctatctagaagacagagccaggtgtacaggatggaacatgaaggcggactaggagcatgaccactgaagcacagcatcacagggagacggttaggcctccggataaccgcaagcgagcttgactaatgtcaggccctccacaagaggtgaaggagtagaatcttctctaaactcccctggggaaagggagactccctttcccggtctgctaagtagcgggtgtttttccttgacacgctacccttagaccacggtccgcctggcaacgggcgtcttcccagacgctggcgttaccgctagagcaaggagccctctggtagccctgtctgggcataacagaaggctcacactgtcttctggtcactcctcactatgtcccctcagctcctatctctgtatggcctggtttttcctaggttatgattatagagggaggattattatagtattggagtaaagagtaattgttacaaactaatgattaatgatattcatatataatcatatctaagatctatatctgatataactattcttattttatattttattatactggaacagctcgtgtcctcggtcccttgccttggcacctgggtggcttgccgcccacatttatcttcttttatagtttattaatgctctgataatttttcttaatattgatacaagacttttctaatcttctgggtgcttctttctgtggccttgggtaattttctcacacatatgtactaatcatcacttggtcaagtatttgaggaggcactccacaaatgcagttttttttcttttgccatcactctcctctctagtaatctatctcctgtgaactctttcagttcacggctggagctgtgactccagctatgttttctcaacacaaaaagactgcctgtctctacctcatttccttctcactgtgttgtagcctggacactttctttatgcataagttggagcaatgttggggctgacttcattttattcctttgtcttggggattatgtgttttcctcctttttcttagttgtttcaccagtaagtacatatttattctctgttatatctctgtggccagaagtcctgatagaacagatttaatttatcagatttttaataaactcgagaacatgtatatacacacaatatatacgtgtatattatgtatatataaaacatatacataattattatatttttgcttttctttgtaagtttgtgtctgtgatgtttactgtgtgtagtatttgtatataggtgtcgtcatttgaatcattggtcccagtttttcatttctccttgtattcatgctttttcgcatataactttgaagttttttccactaaagcacaagtgcttttccagattccttgactttggccttagcaataaggtttgtttgggccaatggaatatgagtctaagttgtagtatgccagttctgagcctatgcctcaagtggcctagcttctttttgcttgctctattatacctctgtcaataccaggagctttcctagtgttttctggtgcagactgagccccaactgcaatgaagattgcaaccagccaagatccacagactgaagcagtttcctgccatgtgcaggctagttcagatgacctcagtgaatccccagaataaatgatagagatgaaaaatatagatatatgcggattcactgacaataataagatgaataatgcatgcagaaatttcacagatcaggtcattatagcgaaataataggacaacatgttatgtaactctggacaagtaagaaaaataatatttctagggcagtccagtttacaaaatactgaaatggacctgcagagtacctaagtctgttggagcatagatgaagagtcaagaaaatgcaggatggagagacagagctatagcaatgctaacaagaacagaacactaagaattgtagttttgtggtcagcaataggggtcatgatgtgataaatgctattatccagactggagcacagtctctgtgagttacccaaaaaaggtttcacaggaagagattcccactggtccagtacagtaacttctcctagccatttggataaaaatttacttgctaaaggggatctcaaaatatagacacacctttaggtttttttaaattgtttttatataatttgcatatattccccttaagagtctgttcttaacccatttattatgcctagtgatccgttattggaacgctaagcttgtgggagttatttatatcctactgctcaaagtcatcaccaaggtttgattttttttttaaaaagtcaacctctggcataaatgggttaaatcgttgttgataaagtgttttcttcattttaatgaattacaacttataaaaaaccttcagcatagatatctaaatattgtggtccttatattattcttagaatgaaaagacttgcagccagagtggccaaacaggtaacactactttctcataattcatcagcaagtttaaaatgtactgcaaatgtgttccttcctcttgatcactattaatttcataggttaaacttggactgtatagcctaacagttccacatttgtgccccaactattcattttctaagaagcagctggtcgtttcttttatctttcttttgcttcgttttatctttaaaataatatccaaactcagggtcatggctcaggatgacctcttctccttccaggatctagccgttgcctgcccctacaccttcatctccaacattggccttacttcctgtgactactctgttattcccatcactcattgtttagaactctcgaaatttcttcctttagggcctttgcatttgttgcttcctctgtcttaagtatctcctcttctgtatgagtcttctagggctgccctagcagaatgccacaaatttatgttttcacatttctggaggtggaaagtcaaagatcacggttatggcaaggttagtttctggtggggatgctcttccttacttgcagaagcccacattcttgctgtgtcatcacatggtttttcctctgtgcttgtgcacttgtctcttcttcttatcaggacaacaatcctattggtttcaggcctgagccttataaccctatttaatgttaataacctttgtaaaagccctatctcatatcacattgggggttagagtttcaacctatgcattttggggacacaatgtagtctatatcaccttgccttatcctttgccacttagatcatcacatggtcgatgccttttcattactcaggtgttatttctaatatcatttccttggagagttctccctcaactattgcttaatcacagtgtattgtaactctacaggacatgtctgaccctgttcactcatcactaaaattactatatacaaccagaattgtgcttgacacatataatgaagcattgagaaaacatttgttgaataaatgttttcttctaatactggtttatgggcataactatttctgaatgtgtcctttctcaaaggtagacacctgagctttatgatccatggtgttatcctaaaaaacagaacacaatattattatattaagtataccactgaatatagcaattggtgtcttgaggagttacaacatgtcattatttaaataggttatcatattttttccagtaatcaccccagctatattaaaatgaaacttctcccctttttctctctaggtagcatcttccttgactctttcttagacagatgctataacttttcagctacttgagttattagtttatttcattatttattgattttaaaatgccaatctcaaattatactcaaaggtttttctacatttcccatctgtgatgacagctcttatagctttaagagtactaggttgtgggtgggcttcaagacatctcttttcactcccacttctagatgccagctccatctgtgatatgacaagagcgggtaaatatcttcttacttgactcaatcagattgcagtcttcttttccttggttgttgcttctcaggctgacacttactctagatgtcctctgcatggttgggctcctaattcctgtaattctgaatggtctccatgtactttcttttagaatcacctaagaggtgttccacttcttgggtcactgaaagaggctggtcaagattcaaatccacttatttaatcactttattcttggttaaaatccaacaaagactgatcctagcataccttttctttgttttctgcctgaatgagtattagcaggccagcttgagcacagcagcattatttacatccatcatgcccaagagtagttcatatccttgcttcatcaaataggaggacaagttaattaccagaattccttatcttagcacctccatctctctgttggtcattgctttcatgccggggcagcaataaagtatctgtggatccaatgcctcactaactcttttttgtttctgagatggagtctcattctgttgcccaggctggagtgcagtggcgcgatcttggctcactgaaagctccacctcctgttttcaagcaattctcctgcctcaacctcctgggtagctgggactacaggcacatgccaccacacctggctaatttttttgtatttttagtagagacagggtttcactgagttagccaggatggtctcgatctcctgacctcatgatctgcctgccttggcctcccaaagtgctgggattacaggcttgagccaccgctctcggccctttgttttgtctttacatctctttttcaaatttgaaattatttctcatgagagattgtccctaaccagaatattatttcaatttcaagtactttattcttatttatttttatctttataatttaccttctaagatttttttcatgttcttattttgctactatatatatttacttagttatatgttagatataatattagcaaacaagactaatatctattatcagggaaaataggttttcaactttatagtatatgacctttagaagtaaaatgttaaatttttttttttttactattttacaatgtttcttttaaaactatttcctatttatattcatttagatttaaaatcctccaataaggaaataacttattttctctgctgaagagttgtaaaattcaattatgcataaagacaaacatcatcctgagtaaagaatcatccgtaagattagcggaatgaatctgctgcaacatttacacttcatactctgaaattgatttttatgcattttaatggaagcaatattttgcatttgagtacattacataggaaaataaaatgtcaaggcttattcctcacagaattcacaatctccgtttctgtttctgtatttttttctctttttacttagaggaattgttatgagatgatctagtggtcagttcatttctcattcttttagaacaataatttgcacattaaagtcctaatacaaataaatataccctatgttcccatctgttattcttactctattgagacctagtataagagtagagcagtaaatggaatacagtcttacttctcaaccatatctttttttcaaatggcaaaatatgtaaatatttctcatatgtttaaatttttacttttatttgaaaccactaatgcccaaataatgcattgatctcagtcatgggaagaggtggtaagatatgattaatatgtctttattgtagcttgctgtgatttcatgtaaagaacatgccattttatgactcttactagtgtaatgaataagtaaatttttagctttagaattaatgcacataccctgacattttatatctaattgatctgaaagaaattctaaagagagttaaacactttaagttcccaaacatgaagaatttgaataaagcatgaaaggaacagagagctatttgttgtttactttattctttgagaagctaaaactcagaatctaaagcacagaagaaaatgtcccaattttcaaaatcaagaaatcaagaatcatgtttacatggtttttttaactcacactttctatgagccaagtgttgtatttaaagatatttcattgaacatattggacacagtttcttcctgcaaagagttaacatttgcaaagccgttcccttattacttcctggatattttttccttcctattttagtgttagattattttaagtgactcttgattcttatttttttacttgaaaaatatggaaaaacaaaacaaaaactaccatttagtgacaaactatctggtttccaaaaacctgaaaaattaaaatagtttttgtataataataaacccatgtaagaagttagttatgatttaatggaaatgctgcctctgtatatgtaatgtaaagagggggcaatgtaatttattgatgaggcatgcaggctctggatttcagattgactgagttctaagctcagttttgccactcacagggcaagctgttcaagcactacaatataggagagagagcaatacctatgtcatgagatttttatgaggattaaatgagataatgtacataggagatttagtaaagcacctctcacttcgtaagcactcaccattattatgcaacatttcaacacttttttaataaaaagtaatttaaaactattagggaagagtgagacaggaagagaaagggagagagagagagaatgagtaaataggattaatgaaagagttgagtttaaaaagtctctgatattagtactttgggtagaaaaattttatactagtcttttgccagatgcatagttactaaaaattctgtaggttgtctgttcattctgttaacagtttcttttgttatgcagaagctcttttcattaattatatcctagtttttgcttttgttgcaattgctttcagtgtcttcatgaaatctttgcccgtgcctatgtcctcagtggtatttatggttttacatttaagtcttttttattttttaaaaacagtctcactctttcgccaggctagtgtgcagtggcgcgatctccgctcactgcaacctctgcctcctgggttcaagcaattcttctgcctcagcctcccgagtagctgggactgcaggtgcacaccaccacacccagctaatctttgtatttttagtagagatggggtttcactctgttgaccaggatggtctcgatctccctgacgtcatgatctgccctcctcagcctcccaaagtgctgggatttcaggtctgagccaccacacctggcctacatttaagtctttatccatcttgagttaatttttgtatgtggtgtaaggtgggggtccagtttcaatcttccgcctatggctagccagttctcccagcaccatttattgaataggaaatgcttgtcttgttgcttttcttgtttttatcaggtttgttgaagttcagatagttttaagtgtgtggttttatttatgggttctctattctgtcccactggtctatgtgtctgattttttttttttttttttttttaccagtaccatgctgttttggttactggagcactgtagtatagtttgaagtagggtagtgtgatgcctccagctttgttctttttgcttcggattgccatggccaatcgggctctttttggttccagatgaattttagaatccttttttctagttctgtgaagaatgttaatgatagtttaatgggaatagcattgaatctataaattgctttgggcaatatggccgttttaccagttgattcttcctatccatgagcatggaatgtttgtgtcatctcttatttctttgagcagtggtttgtagttctccttgcagagatctttcaccttttgacttagccatattcctaagtattttcgtctttttttgtgtggtagttgtgagtggcaaattgtctgtgacttggctgtaagtctaatatcctgcatttgtaaagaacttaaagaaatttacaagaagacaaccccataaaaaattaggcaaaggacatgaatagacacttttcaaaagaagacatacatgtggccaatagaaagaaagctcaacatcaccagtcattagagaaatgcaaatcaaaaactacaaggagataccacctatcaccagtcagaatggctactattaagaagtaaaaaataatagatgctagcgaggttgtggagaaaaaagaaatcatatttatacactgctagtgagagtgtaaattagttcatccattgtggaagacactgtggtgattcttcaaagacctaaagacaaaaataccattcaacccagtaatctcattactgggtatatactcaaaggaatataaatcattctattataaagtcacatgaatgtgtatgttcattacagcactgttcacaatagcaaagacatggaatcaatctaaatgcccatcagtgatagactggataaagaaaacgtggtacatgtacaccatggaatacaacgtagccataaaaaggaatgcaattatgttctttgcaaggatttggatggagctggaggccattatccttagcaaactaacacaggaacagaaaactaaataccgcatgttctcacttataagtgggagctaaattatgagaacacatgggcacatacaggggaacaacacacactggggcctctcagagggtggagggttagaggagggagaggctcaggaatcacaagtaatgagtactaggcttaatacctcggtgatgaaataatctgtacaacaaacccccatgacacaagtttacctatgtaataaaactgtacctgtaaccctaaaattaaaatgttaaaaaaagagtagccactagaagataagccacctccaaggaaaaaaacacctccaagggaaaaaaaggaaacagatgtactttttacaatagaatgtgttgattcttcttgaagaatactagtgtcagtaggattttagctatttttagtctgctaagaattggcatgaatagacattaacaggttaatgaagtatctgaaaataagtgaatccagttgctgtttaatgtcccaaactcaaacttttaatgctttataacagtctcagttccttttataactgcgaggaaatagtttctttcccaggggcatactgccttttaaaaaaatgtctatttttattaacatccctttgtggccgtaactactattaggaagttggagtaaattatcttactgatgacctatttctgtttctaatagttcttaatcaagaatgatatgcaattgggacacaaattttcttccttcagacttactccaaattcccgtatcctggtccccaaggtggaattgcgtgtctagaattccctttaaaactgtcaatagccgaattttcttttattactctctggcactttaaacaactttggcatcatttaagaattttgatgttttattttgaagttccaaaagtgggaaataaaagcatgcggagggtaggattaacaatacttgactggaccatctagaagtgactgaagaaactggttttgtttatatagagaggagaaacccaaagactgatttagtaactagctatatagagggcagaactaaattactgctttaatttccctggtgaatttgtagaatttaaccactttaaataacagtatccccatttgcaagatgaagataatatttctgctttatgactgtttggggaggattaaatgagacaatatagattaaatattgaatatagtagctgtaataataggagctcaataaaagtgtcttcctttcttttgtcttctttaataggtggtatgatcactatggatatcaaaatgggaagttacagttgcgattacttaaaacattcagaaacattatctgctatggtggttagctgtggaatatcctttctctttctctttccaaggaaaaaaattgcaaaattgatttttaaggaacaagtaccatgatcttcacaatcaaatgttatctctaatagagtttaaaaagtaatggtgatgatttttcagtttattaaagctggaaaatcattattcatgtgctgtttatagatgttatttaattttaatatcctaataagatgctgtaattaaaaatggtataagtgaaatatgatttctcattaatacaacttattaataaaatatttatattcttatggatcatagtaaaatatgaacattatgtcatttgataatttttgtttaattcttgatctgttaaatgtttttaagtgtaagcaaacctttttgcttgaagatgaacattcacctcagagttaatatatgtcttcctttttcttttaatcattggatataatagcttcaaacatttataaacaagaaggaaatgaaatattggaatttcataaaataaaaacaaaagttagaacatcgacttaagtatatcaaaattggaattaaagttaacagttcttgcaaaataacaataaaattctaatatgcatggaatagcctactccacattttgactaaatgtagaaacaaaagttagtaaatattattttctttgttaaaatattgagttagctagatataaacagagtaatttggtaaaaattattttctaaattccagttttattacagcttctagtaagatcaagttataaaagtaaaaattattatataattacatataaattacataaaaattttaaaagtttaaatcccctgtgatgtttttaataaatttattttaataaagaccatttttaaatttatttgaagataaatgaggaaaaggcctaaaatagtttatgtaagagaaatactaattctcaataagaattatgctgaaagagaaaagctagaaaaaaatacatactgaagcacaaaataatacataatgaatgatacataaatatttagaaaatgtaaactattctgacagaaagcagaccagtagttaactggagcagagtatgtagggacaaatgaattgcaaagaggaaaagaaattaatgggggtgatagtaatattttgtaactctgttgtggtggtttcatcaaaatttattgaattgtgtattcatcaaattggctgcattttgcagcaatcatatctcatcaaagtttatttaaagaacaagaacaatagtttcacttctttagttttgaagtaaataaagaaaatatgaaggcactatttttattaaccaatggattaaaaaataaaatgaaacccaaaaaattaacaatactggtatcattgaaatctatgaagatggtggcagtatcagttggtcagacttttggataagcaatttggtactgcgtctccaggttcatcaaaaatatacttaccctttgacataccagttttgctcttatgagattgtcaatagaatgatccagaaggataaagtgacatgcaaaaagactttcttttctgagtaggttattctagtagttttgaatcttagtccagatattcagctgtgcaaaaaatatctttcctttctccaaatcagttgaatctattttttacgtatttgctgagaaggcagaaatttaacttgagttattactactgacttcaccaaattgtgccaagttgctgaagcctaacttaatacctatgaatcagggacactcatcaaatcatttgccattagttcacactggaccccattccagcctgtagcattcagagatctgctatgttcctgccactctctgagaaaggccatctttggaggacatgaggtacactctacctagaagctagcctatttggtgttccaggtagcaattcctttgatgtcttgccgtcatccagagttagagccatagagcacgggttatgtctcccctacttctgtaacccctttagtctctaacttttttctcctccttttccttagccactaaagttctcctaacctctcttccccttccagaatatctagcataatctttttagtgagcttggctacttcttagaacttgggtgtagagatgtgtgtggtgcataattattacctcataaattactccactaaatttgttttaatgaggagtttgtaaatgcaaggaattaattagaaaagtatctagtgggtgaaatattattgctaaaattgaagaatagaagcagaatacaaatttatatctactatgaatatgatgtcttaagaatcatgtatactatttgtaatgatgagataaattatgagagtttttctatcgccataaactatgaagttgtgtgggtgtgtgtgtaatttcttaggaaaaatgcatgtgtgttatttaacatactaatgtttgagttggccaatttaaattcaaagagttaaagaataccgattgatcataattatgaggtcatccttattatataagttattcaggggaggagtgactgtgaaaatttgaagaaaagttaagaattttttagaagtgtaccagtaccggtaccaaaacagagatataggccaatggaatagaacagagccctgagaaataatgctgcatatctacaactatctgatctttgacaaacttgacaaaaacaagcaatggggaaaggattccctatttaataaatggtgctgggaaaactggctagccataggtagaaagctgaaactggatccattccttacaccgtatacaaaaattaattcaagatggattaaagacttaaatgttagacgtaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaagttacagaatgggagaaaatttttgcaacctactcatctgacaaagggctaatacccagaatctacaatgaactcaaacaagtttacaagaaaaaaacaaacaaccccatcaaaaagtgggcaaaggacatgaacagacacttctcaaaagaagacatatatgcagccaaaaaatgcatgaaaaattgctcatcatcactggccatcagagaaatgcaaatcaaaaccacaatgagataccatctcacaccatttagaatggcgatcattaaaaagtcaggaaacaacaggtgctggagaggatgtggagaaataggaacacttttacactgttggtgggactgtaaactagttcaaccattgtggaagtcagtgtggcgattcatcaggaatctagaactagaaataccatttgacccagccatcccgttagctgggtatatacccaaaggattataaattatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaaggatgagttcatgtcctttgtaggaacatggatgaagctggaaaccatcattctcagaaaactatcgcaaggacaaaaaaccaaacaccgcgtgttctcactcataggtgggaattgaacaatgagaacaacttggacacaggaaggggaacatcacacaccagggactgttgtggggtgggagaagaggggagggaaagcattaggagatatacctaatgctaaatgacgagttaatgggtgcagcacaccaacatggcacatgtgtacctatgtaacaaacctgcacgttgtgcacatgtaccctaaaacttaaagtataataataaaataaaaagaataaaaaaaaggatgagacccattattttgcttgcgagctagatccaaatatgagtcactatcttaactgtggccagatccacacatgaaggtcacaattcctattttgtgtatttacttgttagactcaggaccttaagagtgggcttttgaaatacgaagtgataaaagtatttactttcacctgtgtgtgtaatcgagaattctaatctgaacttcttgctgattcttgtcatgaaactctctgtaccacccaaggagtttacacactatgaggtactgttgtaaagttctgtgagcttggtacaaatattcaaccccagaccttacctattgccctaagcctagcgataaaaggcaaaatattttttatcggctgaatcgcaatataagatggacaatcatgccggtgaactgaagtaaagtatatgtcatagtcttgtttgtgagcaaaaactaggcagggagttaacaccacttaaatattgtgccaaaatcatgtcacaatgcactcttcaggtagggtatgggaatcagagtcacattaactgagtgctggactaggcaatatgaaaccttcccaaatgtggaaaaaaagaaagaaaaaaaaaaggaagtataccagtaccacaaccgaggaatacagggaatcctgagcaagcggtattatgaggaggctgctggagactcggtactcttggaaaggttgttatgagatggcttagggtataacaatttaagctttactatgtgtaccactttattgaaattgcatttttaatcacaatgattgtagttaaagcattctaagtgtgtactgatagtaatcaaattattctaagttgtaaaaaacttgtagaaaataatgtagacaaaatttaacctaggaaaatttccaaactaattttagtggtataggtgagaagctggtcagtcggtcagcacgagtaaagaatgaagtaacactctgaatttatccacatatatcatggatctttaagaaaattcacatagagatattcaaaacaaattatttaaagatcactagtgagcaaacaaatgaaaacattctggttttactcataaaaagtggtagctgtatgatagtgtttggctgataagagtattagaatgctgaacatcctctatagaaaattgcacatattcttaacctagtaacaataaaagatgatgaggaatgtcaactcagatttaaaaacgaatccttacttccaaaagtgagagacaaataataaattaatgttcattctatggaaatgaaattgagattcaagtagaccatgtatttgataagagccccaaattaaagctgtatagttcaagactataaaatgctgttatgtctaatcaccccccaaattataatacctcttttgtcaagtaatgaaaacttgatatagaaaaggatacatcaggccgttgtggttttagaaatcaaacaatattttctgagaattgttctgagctaaaacaataacaaaacctcagactttggatttgaaagggtttaccttagtagtctgtttaatttattttttaaacttattgctgaccacaatctgcccatctgtgtcacattataaaatatattctaagtctacagtctaattgggaatataactttaggaacatgggaactttagggaaaaagaaactttcttgacaaggttgtatttaagcattctttactcaactgacataatcaaattattctgataaaaatgaaaatatagtaatttttggattatagtttcatgtttctatgaaaaacagtttgatcttagtgatgaattttgtactttctgacctccaatgtgatgttaatgtgaacagatctgggcaaactaaattctgcttctgttccttggggagagttttacaatctttgcaattatcagtgccatggctgtacatgatcacaatctcaatattttcagtgttatagacttaatatataattcttttactgtccatgaaaacaccattgtgagcagtttgttcatctaatgaatctctttcaatttctctattgacaaatgtgttcttttgaaggttgtatcccttgcttaaagtcacctccagctataaattattttttaaaacatcaagaactcagttgtgtctgaacagatgactttttggattttcctttacctgattgcttaacatcacccaggtttaggtattatttttagcatattgcctataccagttgttttcaaattagcataagcagtctactgaaatggttatgtgcacacacacacatacacatacagagtactgtttctatgttccagattgaattgttcatggaactacgatatagaaatcacgggagaggtcctcttgtacttccttttgaacttttctgagacctcagagcaattaaggttcctcacacaacagtttgaaaacttcctttatcattatactgtttggtaaaaattcttttgaaagaaataaaatggtaaccatatttttacatacaatagttccagaatattctgccaaacttctaagaataatttaaaagtagatttaaatcctattccttctttttaacaccctgactttgttttgctctcaattaagattttttagagtttctccaaaactccttttagaaataagcgaaatcctattagaagcatgtgaaatatttatatggggtcattattataggtcaaaaccacccagttttcctgaaaagaagtacacaagcactccagcaatttccactgttattttatctaactcctctcagctcccttttcccctgtcttcttttttcttatgctatattaagtaccttaccttttctgcaagtctctcaccaggatgctttgcagataaaatttcccttttgggtaaaatgggacagatgagaagtaggttttggtggtacataactttaatagacactaggactttttacatagtgccctcttatcattcttctttttttcaatatctcctcaactatattttgaaacagtgatatgctccttctagtattgtaagtattgcttgttttttgattctttgctattacttccttaatgataaaattcttccctacttacagttctatttttgagattttggccttcaacactataggatttttgtagcgtactccatatttgaaaataattttctttatattttcaacttcttacatgtaaagactgatggttcttcatttattgtcggagatctctgcttcttgagttaccttgacttgataatatatcttgatatgttagtcatttataatgtatctgaatgtttctttgctatggtaaaatatatgatagtgctttcatttaatatttattgtattttattaattaggatgttgtggacggaatgtatttccccaaaacctcatatgtggaaatcggattctcagtgtgatgatatttggaggtggggcctttaagaggtaattaggtcatgaagaaatgaactctcatgaatgggattagtgccctcataaaagaggctccagaatgcttccttgtcccatctgccttgtgaggatacaagaaggtagccatttatgaacaaggaagcaggccctcaccaaataccgaatatgccagtgcctcgatcttgtgcttctcagcctcccgaactgtgaaatacacatttttgttgtttataagccacccagcctatgatatttttattatagctaaaacagactaccataaagggtgatttgaaaaataaagtgtgaattatgtctttgattctttaaatcagtttctgtcttgttctatttttggtcaattcctattttatagaaatagtattaggccaaagagaggactaaatatgaaaatgctttcaaagatttcaaagaaaggcatataataaacaccaaatagtataataactattagtatccccattattaatgttgttattttcttcatgatgagcagagcaaaatcattattaaaaactgagctgtgagtgttttttgcattttaatctttctggcaattttcttacctagcttaaaaagatgaccctgacagctaagtcaattgtttttttctcccaacttggacgttcttctatttgagtccctttgtatacacaaagaaggattcagttcaaaggagaagagtcctagttttcaagtgacattcttgagctctattctaggcagtaccctttgctggagttttcccttgaactaatcacttaacattttacatttactttcatcaccataaaatatggttaataatcttcctagatgattgtgacaatcattaaatgaaaaggtatatgtaatgggcactttagatcctcttcctgtatttcagtactgagcaattgtacccatccctcagtgctgattgttggctgctgatagctcacagctgctcccttctctaaaagttgccattgactgggagctactaggtcagttatgtgactcgccgacccctggagaattccatggccattgatggactaatatgagaggttcaaaaggtcagaccccttcctttttaagtatactaatgaggcaaaatgtttgtttactaaaaaaattaaaactaccgttgacttaaaaggtgtatttgaacaaactagatggtaaatttcttatccaaatttattaaagcacttactatgattcatatctatgctatttgctaagaagaaaatgataatacaaacatggtctttgcctttaaggaccttatatttcaacgtgggaagtatgcacatacacacaaatacaaacatacttatatacaaatcacattaactcttggaaatttctatgacttataaaacagaggataactagaggtctaaacttagggtagtcaagaaagacttaactttaagtagatggcggtttgactgaaacctgaacaaacatgaaagggctactaataaagtacaacagcagagagaatatcatcatatgcagtcttttaggcaggatatgtttgacatttgcaagagaatactgatgtgtcagcagtatagtgagtaaaggtgattgagggaagagataaagttgaaaagaaaggtaagatcacacaagattaaatgccatactagagagtttgagttttgctctacatgcagtgggaaaacactaaaggatcataaatgctgagagtggaaggtgatataatttgaaaagaggagagcggatcataagaggaaagaaaggaagcaggaaacaatctgttgtcacatactggttgacacgtcatactggacagaataaaggcagtgacatacaagaggatatatgtctaagctaatatttgcagatgattcaatgtggtaattcagggcatggaaaataatgtttgcagaagcattgaatgttgggtaagaggagaaagtgtgataaaacaagggtatgatggcaaaagatagtgaaaaactaggaaaaaatgagtttcattgtgagcatgttaaatatgaaattgtagtgaggcatttatttatttatttattcattgagagtaccaaacatgtttaaggattgcaattttttattgatacataatgtatatattttgagagtacatgagatatgtttatacattcatataatgtacaaatatcaactcagagtaattgggatatccttcatgttaaatatttatcttttcgttatgctaggaacattcaaattattctcatctagctatgttgaaatgcataatatattattgttaactataataatcctgctgctcttttgaacactaagtcttatttcttttatcacagtgtttgttgttgcagattaatcaatccctcttcatcctttccccccccatgcttcctggactgtggtaaccaccagtccattctctgtcttcgtgaagtccaatttttacacttcaaattattagtgaaaacatgcaatatttgtctatctgtgcttggcttatttcacttaccatagtgacctacagttccatccatgttgcggcaaatgacatgattttatgtatttttatggctgaataatagtctattgtgtatatgtgacacattttctttatccattcattcactgataggcaatgaggttgcttccatatctgatttaaagagcagagttttcaggactaagcgtggtagtcccatcatccccctttgtctctggctgtcctcgggaatatttgtctcttcagacacttgcagtgctttctttgggtgtaggcagggaccagactcctgtcagggagcccagtggggaagctggttgtctacttcagtcttactttttttccagtgtggaaattgtgagtcggggggaaatgttccacctgctaggtgtcaggcagattggagagaagggcatcgcagatatggaagtctgatttccttcctgtgtgttcagagttttttcacttttctgtagccccaggaactctcttcttcaaatttgactctcagatatttctggtgataatctaggcactgtatattcggttttggttttctgtgcaggggattgaagccaacttgctttcttgctgccattttgaaactggaaaatgtctgcagtgagacatttaaaggagttgtacctaacagcctaaatgggctggaaatgtttatcttattatcaacaacatagacaaaatatggcaatggatgtgctcagttagggagggcaggaaaacaagaaggcctaagactcaacatataagttggcaaactgtaaacatttaggaagaaggagactagaaagaggaagttaataaaggagagaaaatgatagtgtaggaagtatgaagggagaaaaacagtttaaacatgttcagctacatagaatgctgcaaaaaatgtgagttaaaatgaaatttgagagtggttcatcggaatttcaatttatagaattcagatgactttaaaatataatttggagagtggtagacacaagcctgttggagtagattgaagaatgaatgggaaatgaagaagtaaattagcatccatagaaaaattatgtagaagagatatagttagttggaatagattatgagagtcatggaacttttttttttaattgggagaaagtggaatattatgagtatatgtagttttgttttatttttaaaatatcttaatttggggcattttacttttagcttgtaatttcaaatattctggagaaataagatggtttttcaatgaatgtttatgtaaaatttacatgtattcggcagtaaagagtttgaaaactgacaattgtttgccacaagtttacagcttttaatcctgatgttttgttacagcaaggggacacttcgaagtaagttgttaggcagtaagtccttgtaatataattggacactgagcaaattgcagtctcaaagccagccctcgtaacctttatactactaagttcaataaaagtgcagaagacaatgaagaagaaacatgactcagaactgagaaaaataactgaacaacttaaaactggacctatcatcctgttgtttgagacatactattgactccagtaagaaaactggtagttaaattgagtgagaatcatacctgctaattataataatgataattattaatgataaaataatgattattataatgattaattataataatgatagtaattttgctatttattacaaatacttatatttatcagcactcaattattgatgtccacttggaatcctggatttaagcattcttaactgttattgcctttattttaaataaattttagatactttccctgtgtgtcttaagtctcaagtatggagagacactgaaatatattcagcataaaagagttagtattataaaatgggttttctgagaaggactttgaattaatatcctaaatatagatcatgtttcataacataaaacaacttcattatatctgagatttcatatcaaaatcggttttaaaagtgagaaacaaacaaaagataatagatctttattaaggtgtgtaagccattttcaatttatcatggcctttggtcttaaggatagaaaagcttattatgaattcttcatgctgtgggaacttgaattccttggagtgttttctatattattatttcaactctctttctctgatcaatccaaattgattttaacatagctataatgatccaagcattcatattctccctagagatgattcctgaaataaaatagttttattctttggctatgtcaaattcttcagagataatttatttcataatctgcaacagcaaagcaatgatgcagttgtttaccatggagtgaggaaattaaccatttgccctcttcttttactatgtatgcccatagattcaaaattttacatatcagtggtaaaaatattgttaattctgatgtttagaatttaatactgacacttttaaagggaatgtaacaccaaaggacctatttactcaaaaattataggaatctttacccttatccagacaatctttttcatttattttcttcctccctaggtacttatttctacttttgcttgtttataaaagtttgagatgaattagtttgcttgtttataaaagtttgagatgaattagcgtactgtttgtagtttttgtttttcttttgttttctttcctctgtactaacagtcctagtcaaaaacaacgaaatcaattattccaactctgtggggtcagttttctcagtcttcctgtgcattctcacagcattacagatacacctttttttagagcatttatcccctactttcatatgtaattgccacttgaccatttatttatcccttgaaatcagatatctttcctggttttgccagtccttgtccctctgatttaaagcctggagtgtatagatggaactgaaaatttggggtctattggacattattcctggaagcactgactgctgtcttgtaatgctgtaaggtgaattgtgtcatttaggagaattttgccctgttataactcagatacaaacctcctatgaaagggtgtcctttctatgactgcctgctccaaaatccacatatttatgtttgactgtatttcaatccagatgtttgcctttttaattactgagttggtacctataccaacctgtagtctattctcacatcgctattaaaagactacctgagactgggtaatttataaagaaaagagggttaatttactcacacttcctcaggaagcatagctgggaggccttaggaaacgtacagtcatggcagaaggtgaaggggaagcaggaaagtcttatatggccagagaaaaagggagagagagtgaagggagagggctacacacttttaaacaaccggatctcctgagaactcactcactatcatgcgaacagcaaggggaaaatcctccccagtgatctaatcacctccccttaggcccctcctccaacactacaaattacaattcaacataagatttgggtagggacacaaatccaaaccatgtcagtacctgatacctcagtgagacaaaccttaatggccttggtcctagagatatgtcatagttgtccagggtataatatcaaagatctggatcccattcctgaggtagtgtgtgataatgtttgcatatttgtctccgcccaaatcttatgttgaattgtaatcctcagtgctagaactggggcctggtaggaggtgattgggtcctgggggtggatcccttattaatggcttaatgccgacttcatgatagttcttaggagatctggtcgtttaaaagtatgtggcaccctctcccactcgtgctctctccctttttcctgcttttgctgttacgtgcctgcttcccctgcaccttccactatgattttaagcttccagaggcctcatcagaagctgagcagatgcccaggctcatgcttcctgtacagcctgcagaactgttagccaattaaatttattttctttataaattacccagtctcaggtatttctttctagcaatgcaaaaatgccctcatacagtgtggttcttatctcagcccaaattattgaaattttgagcacctaactctttgaaaaggattgtacctattgctaatatttgttacacatctctatgtctcaggactctcttaggactcaatgctcggtgctcgcctccctgtagatctagccgtggttccaaccattagagaactcccctgctttcgctatagcaggcaaggttactcagcaggaggggctgtggactttttgaatctctcactaggctatgagtagaagagcatacacttagctccatccatatcagagcaagaagatcagacatactgccccatgtataaacagttcaaaataaaatcttgaccaccacctaaccactcacattctctgcagcaggcagtctagaacctgttgtggtgacttggcccagcactgtagctccctgccagcttgatctcatcaggtgagcccttagagcagactaggtagcagaaaggtagccttaataacagagtggcaaagtgaagcaactgtcttattgcaaaccactgactcatataagtaattctctgatcttgtattttatcttttttgtttaatcctatcattccttttttcccccaggaaagaaagtctgaactttaatgctttgtttttgaaatccctaaatatgtggaaattgactcagcggtcttcccttctgtatttcctgaaccaaaggaaagacagctaaggcctcagtcctaatataggaccagagagaagatgtaatatctcagtggtagctccacacacagaccaactctcccttgatagggacaggtagtcagctgtatatatccaaacctgagctgcccattctctctttctggaactttataaggccacatgtcccagaaaggtaccttaatcctctgagcaggaatataatggacacttggaaaacatcagtgggtcacttcatgtatcaggaaccctggaaaaccttgccaagaataagggcattttctatgctgatgctctttaggaaatactaagagaacactaacggatcttgtaccaaactgcagaagcagcagtgttgtggaccttttcaaagcaggctccacagctggatcacttcacttccaccctcccaccctgagtgagctgcgtaatctttagttagggcttttgcttgtctgattcctcagtgatcattgccttttctaatactagccaagataggaagcatctaaaatttagcaagtataaaaaccaaaatatttattttaagatctatagagatgtttcccagtcttttgaatatattgtcatacaaagaaatatatctgttcagcacactgaggtcctaatgcctctatttattgctacaagtgattgacccccagggctgccccagaccctgcccaaaagccctgatggctgaaggaatttgtccacactggttggaaatcccaaatatatgcagaactaaaatgtttagcagggcactcatggttcttcatagactattttcctacatcatctctctctatttctccaatgtatggcctttcagccaatggatgatctccatacagtcagtagagttttatccttcatacatgtacagatgatgctttccaaacctagaatacctgctcaggctttctacatgtgacaaagtcctttttatgttttaggattcagccaaatattataatctatttttgcagaaagatttaggcatttttttcttctgtgtttctttagcatcttgtttataacacagctttataatatttcacattggatgtaattatttctgcattaatcaaacacttcaagcaagaaaatgaaattaacttttgactaatcaacctgtatataccaggtatgatgctttgtgcttttacagacatgattgcctttaaccctctatgttgtgtaaggcaggaaggctcaaaaccatttttgcataagaaaatgatagttagaattatcctacaactttcttaaggtgaaacatctgataagtgatgaggaatgaattgctattaatgttctcagattttaccaaccatgtccttctcatttgcctggttctttaaaacctggcctaacataaagatacccatcaaaatgtttaactaataaaagagggaaggaacaaaataacaaagggaagaaaggaaacattgaaggagaggataaaaaataaagggatcaattaaccaaacaactatgttctaggaaaaaaaaaaatctctggatttgtatgcgggacaccgactcaattggcttctgactttcaaataataattgaactgtacattagaatacagagatatagtaaatggaatgaaaaaagtggaggtaaactataaaaacttggtcaccaactttttttaaaacaaagtatatgcattaagataaatacaaagaactttgtttaactcaaataaaaatctgtctttagaaagtctaaggaaaagaactcttctcatatggataaattagtagaagaaaactttattgtgaagtattatatcaatttgaatgtttaaattcaaatatgtagttattgatttattttaatatctggtattctatgagacactttgaacttagtctgtagttaaatatggatgcaaatattttaataaactgtgccgtttttaagactttaagtgatatttggtgatctaaaatatcatctagtaaagataaaattcagtaatgtatagttaaaaaacatagtttctctttctcaaatctagcatgttaaagaaaatatctgatactggtattttgtatcattatatagttcagtcaagattatctccctgacagatggctacatgcaaagctaattgcaatatgattaagaaggatcggtatgtcacaaaatgataaaattgccgtaaatagcatagagcaaaaatcacgtaatcaacacttatctgacatagtctttttatgaagcgtacaaatctctaaactgctttactcatttcattttttttctttccttcctgggaaagaaagaaaattgttctttctttcaatagaaagaaaggttgattgttccttttctaagtaaaaagaaagctagttaaatactcaaaagaaatcatcataagttacacaaaaatagataaatctcagaaactgaaataagtaatttcattgctttggaaattttataaaatatagtgaaaactaccaattcctcatagtcccgttacacagagacaacatactttgtacgttttttgaaaagtagtgattttaaaatgattatgtgtttgtcagcaatgtttgaccactgcccttcttgaaatggtgggtacatatgtaggtatgtgggtacatatcatggtgagattttgtcgccattcttttttatttatttcattttcacaatataataagaagcaaagtaaccagctgagagtgttggaaggtggaaatattgaagatttgaaatcatagtgtaaaacagatagccaggagtctggaaatgaatgttctagggaggtattaaagtcctcaagacacagaaaatctctattttatgcaaattcctctattgattagaaaaagagagattcttcctaacttatacagctaataagcttaacacctactttacacaagggtagtataaaaaggacaaatcaaaccatttttatatttgaacaaggacatcatagtcctaaagaaaacagaagcttaagcacaatgatgtgcaaaaacgaatgcagcatgacctggttggatttatcccatggattgaaggatattttaacataaaatctttttatataattcatcaccttagccaattaaaggagaaatatgatcatttcaatagatgcagaaaattcctttgatagattttaacacctacccatggtaaaaactgttggcaaagtaaaaatagaacacaatgtccttaaaacagtaaaggatatattcaaaaaacatacttcattgtgaaagtttagaagaattgaaagacatgacaagatgcccactaccactactttgttcaacgatttgtttgatgcactcattctacagatggaaaacatttaagaatggaaaggaaataaaattgttatttagagatattattatctgtgtagaaaatccaagataaagaataagctatccaaatcaataatagaattcagcatatcactgaacacaaccaatttacaaaagccagtagtaattctatctcccaacaagaaacaattgaaaattataattgaaagaaaattccatttaataatatcattaaaaagcataggggcctaggaaaaatgtcctgcaaaaattttagaaaataatcacaaaactttattaaagatcaaaaactaaaacttaaattaccatttacatagatgaaaaacttcaatactaaaatggatgaatgtatatcattaataaactaatacaagaattgtctaaatgactaattcagtttaaaatttttattgataatgtgtttttctcagtcttgtttaggaaatccatatgtaccctatcatcatagatagtatattcttttaaatatttttaagtatttgatttttatattctctttttatcaacctggatttgaatttgtatatggtataatgatagggtgtatatggatttctgaaacctggcaggataagctattaaaaaatactaaacatattgatttatttaataataaatttctgtaagatataagaaaccaggggccgggcacagtggctcatgcctgtaatcccagcactttgggaggccaaggcgggtggatcatgaggtcaggagatcaagaccatcctggctaacatggtgaaaccccgtctctactaaaaatacaaaaaattagctgggcgtggtggtgggcacctgtggtcccacctactagggaggctgaggcaggataatggcatgaacccaggaggtggagcttgcagtgagcagagatcgcaccactgcactccagcctgggcaacagagtgagactctgtctcaaaaaaaaaaaaaaaaaaaaaagaaaccagaagagaagtggaaatactatctacatcttatataagggatgggtagtttatattatgtgcctgaagtctggaaataggaaaactttgtacagattatcttttaaaaattaaatctgcagtgaaatttgctttgaaatctaatatttgtaaaatattaatatttgtaaaatagtagtacagagtactaaataagtggattgtataacttcagttggaatgaaagaagcaatgagcattggagtaataattgcactaaaaaccatatcaagacatgggttattttccttctgaaggaaatactggagaaatgctgtagttgatgtcgatttgagcaagacatttggcagtcattcacaatggcattattgacaaatgaagttccaggattgttcaataatggatcaatgtctactttaatagaattctcaaatatatattatatagctctactcatagaaatatcatgttttagtttgatcaatacagttgataaacatataaaacaattttattaaaatcaagaagaattcaaatatggaacatataaataattcaataaaacaaacataacatctgcccaagatgaagatttattttgttgctttagataaagttcttgaaaactaatagaaaagctatgacaagcatatcaaatcatgctaaggctgaatcttttgagagaattatttttgactgggagaataattcactaagaatatagtagttgggcagtggcttgttggaagggtagggtttagtaaacggagtggagtgagaatggttgcaggtgaagacactgcatgtgaacaaaaggcatagaggtgagaaattgagatacatcgtcacaaatggcttaaatgtgacatctagggatcaaattaaaattatcttgaatgccttgttacagatttggggcttcatttattaaacaatggaattgaatgtaattgaacataaagattattcttgcaggagaatgtatgatgtattagattagtgagagacattgtaaggaagacaataattctaacaaaatagaatttctttctgagctgtgacattagtgatgggtgggattgatgtgagaaaaaccacaggggtcattagatctgtaatatttgtacatggaaaaattattaatttaaccaatatccattgattggcaagtaatggagataaaatagtgaacaaaactgtgcaaaatccctgcttttaaagaccttatttaaatgaggaggagagaaagataattaacaaaacccacaaatacaacttataatacattaaaaaacaaatgctgcagaaaaacgtgaagcaatgaagagagaataggaagtgtgagatttggggagcagggggatgtgcagttttatgtaaactgatcagaaaaggtctcattctgaagatgatatttaagtaaagacacgaaggaggtgagggagtcccctgggatattttggaaatagtctttcttgtttgaaggaatggcaagaacaaatgtcctgagacagaagcatatcggaagaacatcagggccagtggggcttgggggattgagtgagtgggcgacaaggtcagagaggtactggagtgcacctcctatgtaaggccagtgaaatgtaaaggctttggtttttacttcatggcacataagatacattggagaaatttgatcagataagtgttatggtctgacttgtttgttaacagcatctctctggctactgttttgaaaatagattgaatggaacaaagaggaagcagtgagaacagttaggactttactagaagaagcacctgagaacagtgaacgttatcctggcaatttaatttggaacatgtatgactgttaatttggtgaatcccatagaaatattaggaagaataacagatttgtggtaaagataataatgctggtgttgtatcatgttgagttgtaagtgcagatagcgcagatagagctttcgggtggatttagtaatctcgttttacaagtcatcttcacccagagcttattgatcagtacacaaattatgtggaaatgtaagtcttagtgaattttgggtcaccataaaggaatgaatacctgagactgggtaatttacaaagaaaaaaatggtttatttggctcaggattctgatggctaggaatttcaagactgggcatctggtgagggcctcaggctatttccactcctgatgcaaggcacagagggcctggggagatgctaggttctttttaacaaccagatcttcggagaactgatagaatgagaactcactcacccttgaggggagatattattctgttcatgagggatgtaccttcttggctcaaataccttccattaggcccaccaccagcattggggatcaaatttcaacatgaggtttgacagagagaaacatccaaactatagcaatgtgtttgtgaaaaactgttgaaacttcaaagaaaagagtgttaacgagtaagaaaaataactgtttttaaaccatttgaaagctatcagacagaagacaagttaaatattttcttctgctaatctctctttcattgacaagtgatctgaggctctggactcagaccaacgtgatgtggtattcagatagccttgggcaggttaggatcacagcgtctctgaaaagttcatggtgggaaccctccaaaaaagcattaaatccaaatgagatcaggaaaagagagacactctggatacacagcaaattgtgcccaagaagccttgactaggaagaagatttcacgaaagaggtaagaagcagacatgccagaagtaattcatctaacaattagcagacagactcagtagtggcttttggtagactcgagctacatgtgactcgggctgggatgtgtgtcagaaggttaaaaggcacagccagtaagtaagcttagaagagaatgtgaaagataaaatttcagttgtttttcaaaaatatgtttcccataaatagactgtgttgctttgagagcattaaaaatactgataaactaaaatggagggctgcctatcagaaataattttaaatgggtatttcaacagaggtaaggaaatagagttcatgatttctatgttattctccaattctaaaaatacgtgactgggagacttctgtatcttatattgagcacaaagattgcttgtgatagctgctgccttttatgattatttatttgtttattttttactttttcatagacttaaacaggagaaactaaataattgctgttcttttgttgagtactacctaggtagagaagtttaccatgaaattataaaattctatatttcaggctgattatttaggaataaagtagagataaaaatgtgattctcagcataaccttggaattcactcactaaatttatatactaatatcgaacttgaatttacttagtcctggtatgaagaattcttttgaatgaggcttctattgaatgaaaatatggatgttgtcagaaagaataagtttacccaggaaacatgtccaatgataatattttagacaggcttgtcaggacccttagagaattgtgaaaattgagaatggcaatacataatggaggcaatctatgaaacaattaataagctatccatcactcatttgtttaacactaaatagtctcagtagtttcatctgctgacaaaacatcttgtaaacaaccactgggacatttaggatttggaaaatgtcactggagaactgcctttttctctaataaatggagcaaagaaatacttattaaatctcctccgtaaggagatatagtatgtatgtttatgtgtggcccagaatttgtggtgcttaagacttgacccctgctgtctaggaaatggctgttttgtagagaaggtaaaaatataaaaaataattacaaaaccaggcactatatgctctgtgccatatgatattcagtgttatgcagagtctcatagtcatgtcacctacatagaataacctggaatactttttaaaaatatctcttgacttgattcagtccacatccatggaaccaaaaactgtgtggaaattaggaatgtgtatttttaaaactcatttgatgttagatatgtacccccaaagttacatgataagtgttgcagtagttttcaggaggaagattgcttctagttaattctgtggttctcaatcttggcttcacacaggaattagttggaaggcttcactgatgtttaggtctcaccctcagagattctgatataattgttccagattgcagcctggacactgattattcacaaccaaacatagtagatgttatattccaaatgttatagtctgtgtataagaccattcatgatatcatacatctaatactcgatccgctagccatattgaactacttgaagactccaaagtcgtgataatgatgacaattaaaataatagtaatgtttaatatgtatttcgttatcattatgtgccaactataaatttgtttatcttcatgaaactcctttgatatgaatgctattattattaccattttatagatgaggaacagagacaaagtgacttggctatgtctacatggttaataggtgaccaaactgggatttgaacccaagcattctggctctacagtgcacactgttacattatgccactcacgcatatactctatttcccccatgcctgcctcatatgattgaactctgtcatatgtgtttatattgccttgagatatcttcctctaacctcctgtatgatgactgtttacccattttcagttcatagtttaatgtgacttccctacaggaatttttccctacttcctactctgaggagtgatgcttctgttgcagttagttgccaaagactttaatttttttttctttgtctgtccacattactgtgtgagttccttgaagaaagagactatgctacatttatttttgtagctcccttaacaatgtctgcaacatagtcgccactcaatatttgttgactaagtaaataatttaatggaggaatgcatcattgaatgtatgggaaagtaaaggtgtgttttggtcttttaagtaagttaattgaactggtttattaagaagtaaagccaaaaatatttcagaagccattaccaagctgctttagttcctgactggggtttggatttcattttcagatagtaggggattattgaggattttaagtaagggagtcagataatataccctgtttctaccaataacacttgataaactcaggggaccagctaggaaatcctgtgaacaagccttaaacatcccaagccatcttggatacaatgccatctctatcaggggaggcctacctccatctaactaaatacacattgtcaactatggtggtggacagaaatgagcaaaatgtgagggatgaaggagtggtgctaagcccagttccaagaggtgaggtatatataaaattagttgcaaatggcctgcaaagcatagcatattatctggccctttacagaagtgtgactgactggaagtgttaaaagcatagggattaattaagcgacttatataggatattacaatctatatgaagtaatgaaggtatgaatgaggtaataaaggtattttatcatggagccttttaaaattgaatctatcaaagttaatgccatctcggaataaacgactaggagtatagagcataaagggtgaagggttatagtaagtaagggtagaggttctgtagagagtactcacagggttagtctggtctagagaaggactagtaagttcaattcgagcagagctgtgagatcagatgtagtacatgggaacatgtgctggtactgagatagaaccaatagatgacccagaattggaaagaattaaaggaaagtataggaattcctcttctgaccacagtagacacttaaaaatgattactaaattaactagactggaactgacagaagaatcaagcgatctttaaatccaggtaaactatagagagtaaggtcctaagaaccaagaaatgttatgcaagaatgggcacatctcaaacagcctaggttcaggggagtaacctcagtcagccttaatatgagccactgagtcctatacaacttgcatttgtaagacactaaatgcactttcacatgatattttatttatatttcttacagaaatctgataatgtagtttaagcagacattatgccttccattttacatttatccgaatgagggatcatgagtatcttctcagaggcaaatttaccttatagctgaaaaagcttaaccttcagagtacctcattttcatgtgtctctttcaaagccctgtatctctatcttagagaaacgctcaaattatataatttcaggacaaacacaatcttgatcttcccttgtgtttcacctaacctagatggcattgggtgggtctgtaacatcagaaccagggttctttctgttataacacagtgtccactgtctgcctttggcgtcattcatggctaggtagtaaccaacacctagggggcttactacatatgagatgacaaaattcaaagcagccagcaagtgcaaaaagcatgttacaaggaaagcagcagattctgacataactatctaacacacacacacacacacacacacacacacacaacagattaagaaaactacctgaatccctaaaaagagatagtttatcaagatttacaaatttaatatttctttcgaatgatttagtacatgaatggctaaaaataggtttcatatttgctctggtattcacaaacaccagactgcaattcacaaacaccagactgcaattcacaaacgtgattgctatgagactactgaaaatgaatattagttattagagaaaagaaggtggagttgtcacttgtgaagaaggggcattcctctactactcccatttattttcctctttaaaagactttaataagtgcatcattacagaatggcataaaatatgacaaaaaaatcactaaactgtgtaactgcttaaataaggagaggaataaatgtccactttctaagtcattatgtcattatacactgaaatgagaagaaaatctttgcatttagttttgaaaaacatcttgaatataacaatcaataataagaaagaaatatttcttataattattgcttcaaaaaggtatgctcagaaaaatgaaatccttttctaatttttacctgatactaaattttatttagcctgttttatatgtcaattatgtatttctgtatgtatttaaagattctaggtttcattgtaatggagtgattatcatgggtactttttttttctttataaacctttccaagggtaatgataccttcactttcttccattgccctctctaccatttaaaatttttgttactttcttaaaaatttcccccctttgggaaataatgaagatgattctgcttagctgtgtagactcctgattcgtagtagtggaatgggaactgggccaacacatttaatttgcatttctcctagaaaatgttgcagactaactctttaaaaagcaccaaatcagagatatattctaggcaacttgcatcagaatggcctgggttgcctattaaatatgaaagttactgtgttctagccaaaaacctattgaacctgaccctctgaggatgtagattagggacatctatttttaacaaacaaacttcccaagtgattcttattcacattaaagtctgagaacacaagcttatatatagcctacctcatttaagtcctaggagtgttgcaaatgtattatgatacagttgcaaagaataaaagaatgcccctcatccatagggggaacttgggaaatcttagcttaaaaacctctaccaattaagattcatgagtagaaatggtttgtttatagaaagattttgcctgggtcattaatttttaggaaggcttataatcttttaggagttagattcatatggaaatacacaagggtttgcagactgacactaaaatgaacagctgagtgcttaagtgtggtaggagacattaagaaaacagaatgcttgttagataaaatgtaatgttgaggaacaactgtcctccaggtatctatttccttataaaacacttgcaaatgatttttctaatagcaaatcatgtatacagtttttcaagactataagtatattaaatagcattttcatatttttcctttggcagcactcctttgatttctttatttttaagtaaaaataatgtatttcctaggggatgacaataatgaaaagcttagtacctaaaaaatatagcaaagggcaagcataggcactttagaaactcaattttgcatttttaacttgggaagattttgatctgatgtaatataagttggtattttaatttccaaatgtatttaattttgtacacttaaaatatattctaaacttacatattctatacttatgatttgcctaatattattaaaactttcttctgcaaaagatgtttaatattactgtaaccagaataccatcattccagtaccttgatgatttagagaaaatcgagattaatgctttacacagaatattagaacatgttattcatcttgtgacagctgatattattgctggagtagacaatacagcatcgcaaacctaccttacgtctattggtgctactatataatctactgtgtctgaaagtcacaatttacacttgctatgcgaacatacttattcatactgcccccttcgctctcaagtatcctggtttagataaattatatgctcaccctaaatttgacatccttacatacttggaattacaagtctcttctcctatctaaacattttcacaaatctgttcttttatcagcatcccataataggtagcaaaagcactgtcacaagagaagggaggaaattggtcttctagtttgaccttctccctcagtttggaaatgtttgcactcacaagtcacattacctcttgttggctcttggcctcatgtactgtataacgccagaagtagaaaaatgtccagattcatctgtgctcctggtgtcttggtaaaggacgtattgcttggatctggacccagacttcacagagccccttatcagtagtgcatatgaatataaaatagtagaagtgttttaacatagtggttgagatcttagcctctggagttaaacagacctgggtttgcaacgcggcatcttcatttaatcttccatttctctgtaaagtgggaatattaaaagtcctttcttcatttctcataggtctgttgtgaggtattattgagataggaaatttttcataatacattacacacagtacctattattttgactgctactgccaccaccacaattattgctaccaagactcttgctccttctaaataaattatacacttcccataagaaaatttgagaaatagtttaagtttaaaaggatatatgtgatcattattcctatctgttgccttgttccagataaattgcagagttacataatccattcttgcattcagtcagcaaatacatactggctaggtcaagaaagaatataaagaaaagaatagtgacatgtgtgtgattttactttggttgccggggatatttcatcacaattaattttaaccatcatcccacacactttccctataaatatcaatatttaaaattgataactttgataactaaaccttgttccatcctgccaaatggaggagatattaggaaaaattctttgtatcagctatacactgctggcctcttccaggcttactcatgtagctgcatacagcacacaggttgcctggggatttggcttagctgaggatgctatgatggttaagtctccctcttcatgtggtcttctgtcctcaaaagagactttgcttggtgatagcaatgtttcaagagggcaagccccagtatgaaaggacagtcaaacctctgcttgggtcacgtttgatgatgtcacatcagccaaagcaaatcacgtgaccaaggccatagtcattgtgtgaggcgaatacacagagtaaaagtatcaggagagttgtcttattgagagacatcaataaatgcacctaccacaactatcataatcacagttattatttttgatagaaaggatatactcataatatgtatataagagtgggatattttgaccaggctttatagctgagctagatattaattctccttctacttctgcatgaaagaacttcctgtgttatttctaagaacagaggggagaattgagcattcttgtaatggagctttaatttagacccttatcctttatcatgggcaggcactaaagtttccatctctgtacagagagtaagatgaatcatctgcttttattctgttcttgggcctattatatgttgcattctcatttttttcctaaataataatattgacttttatatggatttcctattttaatttaaacaacattttcaccacagtttttagttgtaaaaagtgaaaataatttatagtatttaagaccattgcagagagaaataggtaatcaatttaactatgtcattataaaatttaataatctgtatttgtttttataaacattaccacatgtttacatatacaaaggtatgcatgtttatatataaatatgtgaaaaaaatatatatataaagccaaccagtgctttttacctgaaacctagagtagctagtatcatctaagagtaaggagttttttttttgttgttgttgttgttgttgagacaagttttgctgttgttacccaggctgaagtacaacggcgtgatctcagcccactgcaacctctgcctcccaggttcaagagattctcctgcctcagactctcaagtatctgggactacaggcaggcaccaccctccggccccagctaatttttgtatttttggtggagacggggtttcaccatgttggccaggctggtcttcaactcctgacctcaggtgatccacccaccttggcctcccaaagtgctgggattacaggtgtgagccaccatgcccggcctggagtaaggagtttttaatcaagttcttttattgttactttcaatataggtattcaaatgattttaattactcaggagcttaaattctcttattaaagtgaatttctccttaatcactttttgcctacaactggactttgaaaaatatataaagatccgtgaatcaattccactgatttaaagggtgttctaatagaggtagcttgaacaagacttcttagtgatttatcttatgtcagtaagattgtttttatattttatatgcaaagtgatttatcaaaaacacaaaagactcagacaaatcctggagggaaaatgtctttctgatctcaggttaacctcaagagcttgggttattcattctacaactggggcagcatggaggagtggggggacgcagattatctctgcctgaacagcggagtctttagatcaaacaccaaaaataggagatgaggaaaaagacaagccttaagtaaaatatacaaaagcaaagcagctggagaataagaaaactattgttttcttggatgtaggagcaaagagagggaccccagaagagaggaaagcaaatatatgcctcttagtatctgattttcagagtcattgaactaggtctctgagaatcaaatttttcttctcaaatgatttttctttgtaataatagcctatgcaaaataaaaccagctgcctcaaaggaaaacacacatctttccttgcattccaaatgctttgattggaaaggaaatctcagaccccttagggcattcctgtctcttggggaagattatcattttacgatttgataagtgtaacacacattgaaattcctgcaagatgtttgactagtataggatttcatattttcagtcattagaatgaataaattatttcagatatattatcatcaaaggtattgtaatgtggggacacaggaaaaattcacttttcacctatgcattcctgagagctaaaaaacaaattagatcatcatagatcagctcatattttcacccacacaattttgttgttgtgaattttatttttattcctgatttattttattcctgatcaatttagcaccagagtcatcctagatacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctaacactcagcccaagaacctagttaataaacccaaggataaaaagcttagcatagagaaacaggtaatggtggcttgggtggttcagaaatgtcagtagaataaagacttgccaaatcttggtaacagacattacaaaattaggtaaagaagaagtagctaaaggttttcttataggacccaaacaccaagaaatgaggtgacaggaattgtatgtggtatatagattttatgagaggtggagttacacctggaggtggacatgaattgtatgcttaagaagaactaagcaggaatgagaactatgaaagttttcctttaaacttaggactaaagtcagaatgtagttgagacagaggtacatacggggaaatggggcaacattgaactggagagccaggtgaaggtgttactgccagagaaagtggtcatatccaagtatacaaaaagccacattctgtactttgggcccagagcctttttcctcttgttcttgtacctcaagtagatgttgatcagcttaagtaattgcaaggatcagccctgtatttcttcaataattatagaattggaaatcatagaaaacaatgtttggtttaaaatgtaaataacactaccactatatgtttatggtaaggtaggatgggaaaataaactcgggaaataggggatgagaaggtaaaaagaaataagactgtgctttggatgtcctatctctgaaagtggctatctctgaaagtcacttaaacaatgatgccctgtaagaagccaagataaggcagggaataggaaagaagagagttcattcactcattcattcattcatttaacagctgctgaaacgcatactatagtatgtgctattatactatagtatgtcctgggtgctggaaatacagacataaaaaggcatactatttaccttcaagaggctcccaatttagttggggaggtagatttgtaaagaaagaaaacaaaaattatattacagaaatatttatagtatgagtgtgagaagataggagacactagttcagccttagtccttggggagtagaagagagaaaggaggtgaagattcccagtgactatatagcttcattgtatcttgaagaatgaacagggataacacaatcatacaagtgtataatggagaatgagtattataggaatacagagtgacacattatgcagcctatagttgtgatataatataacatgtttaggaattgaaaatatcacattgatggatgtatcagtcagggtctaataaggagacagaaaccacatagtaaattggacaggaaatgtttatataaaaattaattataacaggacttgagtaagaagagattggctaataagaagtaaagagaactataaagatgactaaatagcagaaggcagagccaccacccctaaggctgagatagggttcccgagatagaatgggaaaaaattttgcaatctgaatatctgaccaaggtctaacacccagcatctacaaggcacttaaacaaatttacaagaaaaaagccaataatcctattaagaagtgggcaaaggaacactatatggtttgggtctgccccaacccaaatctcaccttgaattgtagctcctataattcccatgtgttgtgggagggacccaatgggagataattgaatgatgtgggcggttcccccatactgttctcatggtggtgaataagtcttatgagatctgatggttttataaggggaaacccctcttgcttggttctcattctctcttgcctgtcaccatgtaaggtgtgcgtttcaccttccaccatgattgtgaggcctccccagccacatgggaactgtgagtccattaaacctctttttctttgtaaattacacagtttcaggtatgtctttatcagcagtgtgaaaacgggactaatacagatgtgaacagacactttctcaaaaggagatatacatgtggccaacaattatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaatccattatccccagcaaacaaatgcaggagcagaaaaccaaacactgcatgttctcacttataagtgggagctgaacaatgagaccatagacacagggagtggaacaacacacacttaggcctatggtggggaagaagggagggagagaatcaggagaaatagttaatgcatgctgggcttagtacctaggtgatgggttgatagtgcagcaaatcaccatggcacacgtttacctatgaaacaaaccttcacgttctgtacatatactctggaatttaaaataaaatttaaaaatataaaagaaaggacaggagaagcataaaaaatagttaaataattaaaaaaagaaaacccttcatcttctagtgtctctccagcgtacacttctgacagagcttaaaatcatgtcagctggtaagtaataaaaataattgaatgcccaagctcaatttttacaaaacaagcaatgaagaatgattttggagttcaagggcaataaattgataactggaacaatggattaaaaggtgcttggaaatattacaaatggtgtaggagagaagccaagttcagatggttgtggacacagaagagacaagggctcaggaaatttcatagtccacattctgtgatgtatgagagaatcttggttctggatccagcatcttataaaaatagatatctacttgctaaatttttgcatacactcagactgcacagctaaatctaaggaagaaaacttgtgtactgaatttgtcatggagttagctcagtttttctttaattctcagttcatatagaatcctcaatttatttgaaccatgtgtgacaatatgaatatcaagttttatcattatttgaggtaaataatataaagtgatcaatgattacacgtgtgctcctgtcagattttcagagaggctcaccctcacccaaaaatcctagcaagattatattcttccagaatgctctaaagagccaacttctctttcttcctaatatttacttcaattcataataacatattaatgcacagtgtttgataaagtctgtattcctcactaaactgcaagcttcaagagatcagagactatttttgttctctgtaattttctgaatatctggtccagtgcctgacacatagtagtatgtcaataatatccatttctttaatgaataactgaacaaatcatttaggttttgctgagatgatcttgataacccagaaaaacctgtcttttcttattagtgccgtttagaggtaatgacatttacattaatgtcctttaagtcgggagtacttctgataccaagtgatactggtcagtgcttttcctatttatatgtgttaattacatatgagggtccactcccctttttctcacaattgctgcctctggagaaagctcctgtacttcacaaaccacatttgcttcatcgtgactgctgcttcaggattcttccttttgactgttctcagaaagcaaataaatggaaaggagaaaagacttgattaaattctcaatttttttcatggttgtttactgctctaacctatttaaaatgtatatactcaatttaggtgaagtatatttgggttttgaaaaatttgctgccgatagaaaatatatatctgctatgaaaattaataccttaagctgtgactgtcaaaattctttgaactaatgggcctttacagagagtgcattatttagaatcgtttaaaagatgcaaacaatgcacgaggagattcataaagctataaaattattctaagccagaacagaatttccctgatctttaaagggatttagctattaatttttaaatgctgaacatagttgacatttcaaattgaattgttactgaggtaatcacattgaatctcttggttaaatgttcaaagtagagtccatgaaatatgcatgttaccaaatcaaggcaaagagtctttcttcagaatacatgatttttatttagataaaatattagatgccttttattttaaaataaaactatctcttaataggaagatgcacttactcttcaaagaaaacctgtgtgtagaactcaaggggtttgtgcaatgtttactctacaattcaactcattgcatatccattgtttgtgaaaaagtgaactgaaaacttgtaagactcgatttctgatatcaagatacttagactctgatagtatttggaaaacacactatttctaggaagtattacatatcacaaatattttccaagatcaaacttcccaaagtgtagtattgataattttgttgtcacattaaatgagtttatgtcatacatgagccaacatgttataattttaattcatttttaattttgtattaactgtcttccagtgtgttcagatcatatgatactatttatttttagtaactctctaaagtttaatttttaaagaaatatttgtaaaagcaacttgatttttttaaaaaaatcctagtaaataataatacatatggcatgcagatgctcacaactataaaatgattaatgaatggtaattgagaaacaactctaaaaactctttttaannnnnnnnnnnnnnnnnnnnnnnnnnnntaaatatttgttgaatgaaattaatgaataatgtgattttagaaatttatatttctaataaaatcaaggagggggtacacctagtgcatttaatttttagttagatcttggtaatttgttttgaattaagagtgtttcttctaccataggcctgatagaatatttggcaatgcctatttttccaggaacttctatgcctattttcctaataggatctcctcgacagaagctacacagaatataataaaatatttacaaagcaataacaaaagtgaaaatttctctaataaatactagatatagggattacacaatgtattaattaaaggtacttttatatatttgaatatgaaaatgtcatttatactattgacttcagttattaaataggtcatatgtcctgaggttttaaggttttaggaaagctagagaagagaaaggtttcataaaatatttccaggtaagtcctgcaggagacataccagtgttccaaatgggatgagtttctgctgataagacccaagagaaggagaggtttatcttatcaaaacagatgtcagtggctactaccttttccagtattttgcaacaagcagcctcactggagtcttctcagcacagtaaacagtcggctatttaggaactgtagagatttcagggcagagattatttacaggtatctgttttcatttttttcattgttgttgttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctatcaaattttagaattaattaataaagcagataaacggtattatttaactggcctaacaaggccctataatgtttgccatttattcatagaattaacttttgtagtatagatttttatagggtgattatggtgatcattttccccaaagtatcccatcaataatttaggcatctcccacgagaaaaataggactagatcctttgtttgtcagtaattccaaaaaggtgaagagactttcttaagccaatgtcatggtttttcacaactttggccattctttgcaaacttcacatatctaccactattccttcttcagcttgctatactgttcactcttgccattcttttgtcctaagataaaaataactgaattaactgatgttatttgtaggatatgttttttccttccaacaaataaagattacatgggttgacttgtgtttaccataaagatgttgaagtcctaattcttttttaaaaattttattttaattttgtgttagtccgtttttatgctgctgataaagacataccatagactgggaagaaaaagaggtttaattggacttacagttccacatgactggggaggcctcagaatcatggcggaaggtgaaaggcacttcttacatgccggtggcaagagaaaatgaggaagaagcaaaagcagaaacccctgataaacccagcagatcttatgagacttattcactatcaggagaatagcatgagaaagactggcccccatgattcaattacctctccctgggtccctcccacaacatgtgagaattctgggagatataattcaagttgagatttgggtggggacacagccaaaccatatcacattatatctttatttccataggttttgaggggaacaggtggtgtttggttacataagttctttaatgattattttgtgagattttggtgcaccgatcaccccgagctctataccctgtacccaattttagtcttttattcctcacccgtcccgcattttcccccgagtcccccatgtcctttgtgtcattcttatgcctttgcaccctcatagcttagttcctacttatgagtaagaatatatggtgtttggttttgccttcctgagttacttcacttaaaataatggtctccaatttgattcagcagttccactactggctctctacccagaggaaaagaagtcattatacaaaaaagatacttgcacatgcatgtttatagcagcacaatttgcaattgcaaacatatggaaccagcccaaatgcccatcaatagataagtggataaagaaatatatataccatgggatagcgttctatccataaaaaggaatgaaataatggcatttgaaatcctcatttttagtacctatgaaagtgaacttatttagaaatagagtctttgccaataatgaggttaagatgaggttcttaaggtggaccccaatcccgtatgactggtgtccttatgaaagagggaaatttggacatagacacagatccatattacagggaagacaatgtgaagacacatgaagaacatcatctataactaagaaactaagagggaggcacggaacagattctttatcacagccgttagaaggcaccaaccctgcctacatcttgatattggacttctaatttccaactgtaaactacttaagtaaatttattgacttacagtatatgatggtttatatggcagtcctacaaaactaatacagggcaaaaactaactgagaatcatgagttagataataataactgatttgagcaatttaaacatgtccagttggtattatggcttcaaatagaaaaagatcttcattggtgattaatttgcaagtcacttatttttgtataaatcactctagacaaagttgaaaagaatttcaggaaatataatttgcccattaccataggttaactttttgcctgccatgttgactgttatcagttccttcttaatctaaccttagattttcccattgggatagtaccagtcagcaattaaattaaatatgagtttttctaagtttcaggagcttactgagaggtgtgttttgctcacagcatgtgggttttccactccaggcctcagattaactttgacctaacaagctctgtaactgcttgcagcacagcacagcaaagtgccccctcccgcttctagttaccgtttcttctgttatcctttttatgtcaagagactgctttctcctttacctgtggcactctacaccacatgtgacttagatttacagtccaaataagaaattacagatgtatgatgtgtacatctgccttatgagatttttaaaaatctatcaggacaaggaatccatgggatccaaattgtgtatctttcatcaaacccattccttcatgccgctcgttgtttctttctgatcaatgccacgtgaaatgaaaaggatttccttattaagcaatgtcataacctccttcctaatttttatataatatgaataaatataacctaaagcaagtgagccaagagagacagtatccacttcttatttctacaaagaaaattcagagattttgtcacatcatggattttgctttaactgcatttacacaacgtgtgttagaatgatactacttagactgcacagggaaagctaaatctaataatttatgttaatactgtggcaatcagttatttaaaactaaatttgttaaaacatcaataacatactctttttataaaacaagattcaaacaattcaacaggatatatattttaaaaatttttcttcaatcttcatatgatcgtaaagcatatgatataaatcgctaagattttttcattattttttgcagaatagcctatgcatctataagtatatacagtatattaaagattatttctatttatagcgcatttatattaagtgtattagtctctcctttgttaaaactttaaattattgttttaaaacaaaatatgtatgctagcttcaacagggacaatcactatctcactattgggataatttacatttatttgaatcctagaaaagttgtatatttttaacgtgtttattggccatttatttttttaatattttatgaattgcctattcataccctttattcatttgcctactactgattatatatgctatttctatgcaaattgaagcatactgtaaatgtatacattttaaagttggatcccctttcatatagttacacacaccacgttgcatttatgggtgtgctatcagttattttgccattccctgtcttggtgttcttgatgggcatttaaattgtttcattttttagtctattgccaatagaaaatcaacatacttgcattgacactgacatatttgtatacatatttgtttacttatgtagaatattaatacaatgaaagttagtatgtcagtcagcacatatattttagatttttgatacatatttttaatttactctttaaaatttggcagcagttacacttgtaccagcagtgtagaagagtttttcttttcccataccttaagcaacactcagggagtattaaataatatatccttggataatctgttcattttaaaatggtggtttaattagcaatgttttaatttttttaagtatgagtaagattgatcttgagatatttttgttcttttctgtcgttacttttaatgcaccaaagattctcaaactcctcatttgaaaaatgaatccaatagaaacgttttaattttatacataaaattttgattttaatttcatacataaaagcaaaacaaaattccaaggatattttttgttctgacaccattaagaaacagagattaatattattgctaagtcaacaaataatggaaacaataaagcagagttgcaaaattttagaaattattcttttcacaactctcagcattgttctctgaactctggatatctaaaaacagttactcatatcaaatgaaacttccaattaccatttagtaaatggaaacagaacagagttatgctttctcatacatgtctccatgatggactagagagtaaaactgataactttggaaaagttctcaatggtaccgtgttatcagaactagtttcatgatgtagaatagtgtctgcttttctaccattgtagggagaaaaattgattttctggtacttttttttaccagcaattaggactacttgcagcttcttgcaaaacaatggaattatattagttagtagaggaaaaaagggaatgaaagaaattctgagaggcttaggttatacagagtagaaaagagatgagcaaaggtgaattttaagacatgtagaatgacatatagaatatttcatatctagattgtttttgtcaatttgaattttttactcattcaaaaataaagataatgttcatatcaattaatatattaggcaaactggataactagatgtcgcatgttccagaatttttccaattttgtgtttaaactttgacttttgtcaaatttttactactgaaataatttgatttgttctggggcgtctgggtgtggtgccatacttttataggcaataatgatatgtttagcttctagaaaacctaaagcactgtaacttaaatttttctatttcagagtaaatactaaagatttttcagcttgatatgtatcattatgagaaacatagtttacatgacaccatgtatagaggatacatgtataatggaaacatgctggacatgtctcccctttttattgcaacaagtatattaattatagacatatctcatttcattgtgctcacttaattgtgctgctcggatactgcattttttttttttttacaaattgaaggttgtggcaatcttgcatagagccagtgcgttggctcaatttttcaatagaatgtatttacttggtgtaattcttgtagtgtttaaaaaattttattattattgtatctgttaggtgatctgtgatcagtgatctttgaaattatgttgtcattgtttggggtgttatgaaccatgttcatcaaagatagtaaacttaatccataaccgttgtgtgtattctgactactctaccatctatctggctgttcacctttctctcttcctgtccttggggctgcctattccctgagacacaacactattgaaattaggccaattaattaccctacagtggcctttaagtgttcaaatgttcaagtgaaaggaagagtgtcacatctctcactttaaataaaaagctataaatgattaggcttaatgaggaaggcatgtcaaaagccaaaaaaggctcaaagctaatctttttgtgccagattgccaaattgtgggtgcagaagtaaagttattaaagaaaattaaaagtgctactccattaaacacacaaatgataagaaagcaaaacagccttattgccaatatggagaaagttttagtggtctggatagaagatcaaaccagccacaacattccgttaagccaaaacctaattcagagaaagacactaattctctttaattctgtgaaggctgagagaggtaaggaagtgacagaagaaaagttggaagctgacagagattggttcatgaggtttaaggatgaaagtcatgttcatagcataataatgcaaggtgaagcagcaagtgctgatgtaaaaactgcagcaagttatccagaagatctagctaatataatggatgaaggtagctacactaacaacatattttaattttagacagagcagcattgtattggaagaggatgctctctagaacttttacagctagagagaagtcaatgcctgactttgaagcttcaaaggacagactgacactgctgttacgggctaatgcagcttgtaatgttgagtgggagtcagtgctcatttgctattccaaagattctaggacccttaagaattatggtaaatctactctgcctgtgctctgtaaatggaacaacaaagccttgatgacagcacatctatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttatctctattaaactaatacatcctttacaaatgattatgtgtattttttctttccaggttagattgaaactgacacacttatacagttctggtgtaagtatacattttagtcagcataccagtaggccttcaatgtcaatacactttaactatgtgattccatttctattctaaggatatatgcacacataaaaatcagaacttgcattcgctgtagtattatttaaaaagaaaagataaaataatctagatgtccaaatatgagattatcaacattatgatataccataacaataatacaattttcatgcatcaattaaaataatatttaaaatattattatatttttaaaataatgttagaaaatgctgattatattttgataaaatttggggaacaaaatttatataccaacttaaaattattttcaacttgaatgcaaattttgaaagaaaatttatccaaatattatgtgttaatctttgtaaattgagaagcttttttgcaattataaaataagcatatatcattttaaaaattgtctttgttttttaattaatttttgattgaaaagtaaaaattatatatgtttatcatgtataacatgttgttttgaaatatgtatatattgtagaatggctacattgagctaattagcatatgcatcacctcacatttatcatttttgtggtaagaacacttaaaatctcttttgcagttatgatttcacattttgcactttatttgcaattttcaaaaatgagcgtgtattacttttaatgttggaaaaatataaaactattacaaaaattgtttatgaatcagatatgggattcacacatgaagaaagcagaaagatgtgctaaatagcgtgttatttatttcatttgatttttatattatataagatcagaaatgtataaaaatatatgttcacttgataatttttcgtaaatatcttaaattaccctttatctatttaaaaaattgtttagcatgtcagtgtcagctatgctcaattttccccctgcttttattcatccatattatgtgttctctggattttgcccttgcatacactccctttaaagctttcatttaagaaacttttaatcaattcgagggcagtttatttgttgactttcacgttagtataaaattctactatttatgctattaattttatttaggatctgccagtctcttagaagaatcagtgatatgcgtgtaacacctgtaaaataaaaatacccacgagtatttagtcttttctctggcctggggcacaatcagtactgcatgtttcttttttcttttatttgacaaaattgccagtaaatacgattaaatatattcagtattgaccaacatttttcttactttttaaaatgtaagcattaaagtttactataatcattttgaaagcagtctgactaaatttatagcctcacttttttttctcatgccacagatatttcaattagaaaatgctttggctttatgatacataataaaatatctttgagtccctaaatttgtccattctaacttaatattctatctataactcagatctaccatgagagcaaattatgtaaccccagctaatttgccgtaagaattaacagttgtgcttaatctccttcaacttattttaacaagtgtcttttgttaagacagatgctgcctcaaattcacttttcctgcccctgccatacatctttgtgaaacatgtttctacttccacttctctgcctctgcctggcattcctaatttatatcttcatcataagtatttcacaaaaccattctttagtgtgacagtgatctcatggttgattccaatatcgctttttgttttaggattaagactacttgctattaataattgaagattattgaccattcgttagctttgacgctctttggtatttgctttctggacagtcctctcttttttatatcacatgcttattgcactcattgtttacaccacttctgcaaaacctctgacatatggcagaccaagactgatcctgagcttcttagctttctatttccacctacctttctctatagcgtttttatcaaactatattgataaatgattcccaggtctttttttctactccgaatcttgtttcttctacccaagtctgtacttcttgtattcagtattacctacaaatgaatgtttaccactacttcaaatctttcttaaaatataaatttccagcattttcactttcagaaatttattcaacacacagattgcacaaatttgcaggcatatatacacaaagataatcagtggatcattatttgtaatagttaagtaatgaaaaaatctgaaagttcattaatggaaaaatgggtaaatgaggttgttgtatatacatacatgaaattctattcactagcaaaaatgacaaggtaaatttgagctagaaagatgtccatgatatgaggcaaaatgaaaaaaatgggaaacataacaaacagtacagtgagttagcagatgcatgtcaaacccttaaaatgcttcttcaaaggtttggataggggtggtacatttatttcttaaagtgtgtgtgtgatggtcacaacaatagaaagcaggatgcttttttttatcattatacttgaagttctagggtacatgtgcacaacgtgcagtttgttacatatgtatacatgtgccatgttggtgtgctgcacccattaactcatcatttacattaggtatatctcctaatgctatccctcccttttccccctaccccatgacaggccccagtgtgtgatgttccccttcctgtgtccaagtgttcttattgttcagttccaaaaccacaatgagataccatctcataccagttagaatggcgatcattaaaaagtcaggatgctttttaacaatattacgcttctttcattaaaatttttacttttgttgaaaatagtttcaattaaaaacagattgccagttttccgtatttactacttttaatggcagcccttttctcttattcaatttttaaatcttacactaatcataggcgatggggatcatttttctctccatcttaaagataagaaaactaaaacttccaaattataggttaccttactcaagatatcatacacccagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccagcctggtgacagagcaagactccatctaaaaaattaattaattaattaactcaattgaagaaacatgttaaggggggttaaatcacttgttaaagatacagtattagtaagcaggctcccaggaattgaatggaagggttatgtgactgtaatgtccatactggaatttcaatcattacaaattgatggacaatgaattaatcttatcaactttttggcaaatactgagcaaggattattcatgtgagaaggtcagtctgccttctagggactcattctgtctccattcttagatacctagagctgtttggtccctcaagtctgtgggttctctggagaagcaagtctgaactccagctatacagccagaaggactttcatgattcatttctcttagtcttgtttcttaccttcctgcacctgaagacacagatttcctgagacatacttttgtgtttgatgttttcatttcccctgactctactttgtttccacagtcttctgttcctcctcttcttctggattattctccactttagatctcagtgcctgcctgggagaggactggttttcttcattcctttgtactttgatcgtcagcctctatgatttcctcccagtgtctgtgtcccttgattccctcaaatgctaataaatgttggtcactctaccagtgcttggttggctttattgctcaacattccatatgggaaaggggtaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgtttgaaaacggccaaaacttaaataatttcttaggaaaaaaggttacctaatatcaacctggttaatagatgttgaatattccaggccttttccaggttggctttttaccattgatgacaatattttagaaaattaaaatcatactgaggtcaaaagtccataggctatttttccttactcatttttctggagggtgatctntctgtaatctttctgtaatcttctgatggtggtatatcaacaatctgaaattaatgcaaattatctttccccttgatgttgccctcaaaatgtggagaattccaaagtctcagaaatctgtcattttccaattccacacattgttttcaaaaggagctactcaaacaaatagaaatcaaaacgatctatgcctgttctcctctggatttgtgtatcagtagcttcaaatcctattatatgtaaatgataataaaatcttacattgctattcacgtggcttcacagcagagccagctttcaccctaggagtctctagaagtaggaagtgacttccctagagcatttggtaagcccatcaaactctaaccattttgaaagttgagtgagtcattagttttatgacctatctagctttaaaaacatggaaaactgatgtgatgctggtttaattgaaaacaaacagggagattattttcaccacttcctgaataagggataaagcaatataaatcatattgaaattttgtctgtatttaattactgagtagtgtgctgcaatttatactttaagtactaattattcttaatgtaattatatttaattattataattgctattcatatcttatgttctaatagagacatatcatatcgagggcctttttcacaaaattactatattcccttcatgctagaaaacagaatagaaaatttaccttaatttagttgtaataagctattcgtttcctcatgtattgcaaactgtttcaaaatggattaagttactaatttttatcttttttattaggttattttgacaaggatgttttataacaaatgctggcaaccctttgaaattaaaaaatagaaatagcatggtttgtttgtatataaattatggctttatacattttatacatttacttgtagatcacactataaattcacatcttttttctcctgcgggcattgcagtataaataaaagggtggttagacattgtaatttttttgctctaaatttataatgcattacaatatattcagctcaataagtttgtaaattatagcacataagatttgaaaattcaagaaatggaagggaaaaggcaatctacagtaactaaaaaacaaattctaattcattgcctcatatgatctgaatttaatttgcttacatttgacaagagaaacacctatttacagtgttctttttgatatagtacatataaagctgaaatactgtgtttcagcttgggtaatggagtcattacctcaattttaaacattctgtaacctgaaattgggatttataatggactcattggctgaccaaaatcaccacaagtaaaaacgatttctagaaacttagagagttgagatttattttttaaattgcttttttagatagaatgaggaataatactcaggaaaatttgaaagcatgtacctttagaaccaagaaaaatttacgaatatatgttgcagtgaataaaagagttagatgttttaacacctgtttacactaataattacagtaataatattgaacatttatagtgtatttagcaggtgcagccatttaccaaaaattctatgtgtattaattttcacaaaggccttgtagttaagatattactcttccctcttccattttcccaggacaacaggcacaaaccaacactgtcccaagaaaattacgttatgtgatttcccatcctgatcaattttcagacagtagagcattttgcaaaataggttttcctttgatgttctctatatgatatggaaaattccatagtctcagaagtctttgccattttctatgccattagctcaaaagggatccccgcaaactaactggaaacaatattaagacctactatggatcagagtctcaataaccataaaaacaaaaatatctggagatcaatgtacactggatcggtgtttttaagaagattacattccgaacaaatgttatcctaagaatctgagtaaattagactaagtggaaaaactgtttatgtaaagctatttgtggagattttttgcataggaagtgtatacagaagttcaaaggcatagattctgtgtccaagagaaaaaagttgaatgtagaggtcatcatttaataactttgtgaccctgaaaaatacactcaatctttaaaccttctgttttctattctgtaagattaggctaatatgtatgttaaataatatttgtggtgattaaagggagaatgaccacattctatttagtgtggacccactattcaatcattgaatgttagctatttattattatatgaatgtatttattgtaaaggccatgtatttttcttgctgtgaagatgactctcagtctggtggtatcttatcattgtagtactttaagaaaaagaaatgtaaacctttgaaaaagagaaatactcaggcttcatgtctgtatcttctaagttagtgttgtagtatctggcctgaacatttgcttcttggtggaggggttggcgttgtggagggtgatgaggcccacttgctttctgatgggttgagaaccactgtgatagggaacttggtgtactggaatatcctcaattaaaattttgtgtttttttaaatgctatattttggttaacaaggttttttttttttaaaaaaaaaagcaaaaaattaacatattatcaccacatgtaacaacgtaaacaaaagatagaacgttttccctgggaaagcacagctttgattttacaaattcttaccatatttactctttcttttatttaacagtgtgtgtctatacccagatcttattctgcacctgtcattgtgctgagcaatggggatatcatagagaaggttggaacgagagtgacaacaggagagacagttatagacaaaatgttaatcaaatagagatcacagttttagtcctgtcagtgtatggatacccctccctaaactccaaaagtatggcttctataaattgtcttggaggactagtcttaggcctgagcgaaaataaggtatttgagttttccctcaaataccagttttgaggtttgtttctttcaatgaatgtggaagacaaaagtatatctataaatctggctgagtgaattaactcagcaggtctattattattatcataatttgatgagttactagcattcttttcttagggtataaaaaaactggctaccaaggttattggtactcttttcaacttgaagtgtgactccttgatggaagaagccatattataatatcgagcaattgtatttagacccatccaggtgcatcaggagaacatatatgagtcaacatgggtccaagaattagacaaacttaggtttcttccatgtttcactatttattggctgttttagttagagttacacaattgcaaaaaaaaaagaaaaatcccaaatatatctatggcttaaccaataaaaatgcaaagcagctctccaacacagcatgattcagggagctaggcctctgctatcttgtagctccagtcttgtgtagggtctcaaatccacttggtgggtagaataagagaacctggagaaggctgactagcttattaaatatcttgacctggaagtgacacagtcacctttattcattggtgagaacccaccaacaaacttatttggatagaaatgggagctgagaaatataatccttggttatacagctacttccttgctgtaagtctataacttttggtggatatctagccatcttatcaagctaactgtatgactttaaaaactgaaattctatcattctgattcctgatttaaaaggggaataaagctggatgtagtggctcactcctgtaatcccagcatcttgggaggctgaggtgggtggatcacttgaggtcaggagttcgagaccagcctggccaacatggcaaaactgcttctctaccaaaaaatacaaaaattagccggtcatgatggcatgtgcctgtaatcccagctgcccaggaggctgaggcatgagaattgcttgaacctgggaggcagagtttgcagtgggctgagatcgtgtaactgcactccagcctgggtgacacaggaagactccgtctcaaaaaaaaataaaataaaaataaacgggataatacgcctgaatgataggtaatgaagattaactgagatagtgtgcataatacttgacatatgatctaatcataatatgagttctcaatatatggtaacatgctataattattatcatcgtgtgatccatgctctgtataagtggaatgatgacttccttctccgtctctttagggtgatgtaatagttttattccattcctcccgaatgctgattaatcttatcattttataaaattacagctatttatgacctttttaaatgaacattctttcccacgggagtagtaagaccaaatacttcctttttgtatctaggacctctgtcagggagaaatttcaattctgagattgaaaatggctcttttgggtcagtaactatatcgcttcagatacagcgtgcatagagcaaaggggttacctctgggattggctaagtcatggccagatgatcctccatgctgctgacccttacagcgttagaaaacctatactagtcacaatataaggagttcactctctgctatgtagcgtcaaagtcatatggcctttcaataaagtttcttttattccctgttctgaaatatatagttactgttaacatgtgttatgttgattatgttatgtttagttgcatatttgtaaactacatatctgtttttgttttcacgtggaaattatgaaatcctagagcaaataatcagtttctcttattagacccccctagcaataaatatttccaaaccattaaagagtgacttggtagaatttaatattctggtcacgatatcaaaagtaaacagtaacttttaatcactttctattctcattatatctcctgtcataacaagtattttctcagtttttaaatggaagaacaagcaagcaacaatttaacatcagttgtcatcgtctcttaaagattgtgttgttgcattagtttaacttcaaatcaaagtttagaaatattagtgctaggcagctatttatacttgagttattaacatttgctcagttattaaaatctggttatttctttgaggtttcaatgattgaaatataaacaagaaagaggggaaaatgtcaagtgtatctcattctgattagtattataattgtaaagttcttttagtcttgctacataaactattattttagccttcacattttaaaaggcttcaacattttctcagggaacatctgcaggaaaacaatactttgggagacaggaaaagaaaagaggaaaactaaactgctgaaatgttaaagagtgtagcctttattaaataaatgtgatgtaacaaaatgtgtaaaggactttgggtaaggaaaccggatttcagggtctgacttgcctactgggtgtatgatatcttgagtaaggtaacctataatttggaagttttagttttcttatctttaagatggagagaaaaatgatccccatcgcctatgattagtgtaagatttaaaaattgaataagagaaaagggctgccattaaaagtagtaaatacggaaaactggcaatctgtttttaattgaaactattttcaacaaaagtaaaaattttaatgaaagaagcgtaatattgttaaaaagcatcctgactttttaatgatcgccattctaactggtatgagatggtatctcattgtggttttggaactgaacaataagaacacttggacacaggaaggggaacatcacacactggggcctgtcatggggtagggggaaaagggagggatagcattaggagatatacctaatgtaaatgatgagttaatgagtgcagcacaccaacatggcacatgtatacatatgtaacaaactgcaccttgtgcacatgtaccctagaacttcaagtataatgataaaaaaaagcatcctgctttcttttgttgtgaccataccccccaccttccttttcaaaattatgtggcacaggctgataatgcttaccattattcaaacactcatcagactaatgaaattcctgatttttaggtgggctaatggctacttaaaaataatgaccacatttcctaccctgcttttaagtgatgtgtggccatatgactaagtatgtgagggaaagtggtgtgtgtaactctgggatatatccttagagcagtagttcacaaactttgttgtgtaccatcatcacttgaaggacttgttaaaaaataaaaaaaaaaacaagcaaacaaaaaaacatatgattgaattccatcctggagttttagatcagtaagtctggagaggagcttgagaattttcatttctagtaagttcctaaatgatgctgatgctgcagcttaaatgatattatactttgaaaacctctgctttcttgttttgtttttcttccactctaatgctcagaacatgaatgtgatggctcaggatgattctagaaccaaaagtttaagaaccctgtcctagggatggtggataagacacataggactgaggacctaatatgaaattcattcatattgattaagtctttttgagctggaagcaatgggttttgatttcataatgctgtaacttttaactttgctctaacaaagctattttatacgtatccacatatatggaggaaaatgtatttgcaaaatgtgtatgtgtgtgttttaacctaaggaaatatatatatatatacacacacacacatacacacacatacacacccacacacacacacacacatatatatacatgtctatatctatatctatatagttgagtgccgagcttttcataggaaatatgagtagtttaaatatttagagtagtttagaagtatattattgtatagctatatattttaaatctatgaacatttcacagaactacataaatttgttcaagggtaatgattaataatgagatttactgacttcataagtattgagagtacttggctttcaacctcatgccttatgacttttctaaaccactgaatgtactcaaaagaagaatataacctgtcatgggttatgccagcctgggcatttaaaatctcagtgagacatgggagaaaaaagtcagtatattcaggtgtcttttactcaaagctaaaatcattggtaaacttttgcctattttatgtgattcttaaattttcttaagttttgaataataaggagtggttttaataataaaaatgtcacttttatttaaagttaaaaaccaaaagttagtgcttaatacaatataagggctatagtataatctttttttatattcaaatttagatctatggacagcaaaagacatatgtcaaataaagtctatcatctgttaaaaaactttctaaattataagtaactcagtgttaaatgcccacatctcctaatgtttcctccattttagttccctacgtagtttatgagttcgtaaacatttatttaaataaaaattcaaattccaaaacaaaaaaatccaattgggggtcatttcattaatgtttatcattaaagcagtaatattatgatattatgaaaaaaagaaaaaatgtagtttaagctgaaagaatttgaatgttccaaacacaaagaaataataagtatttagtagagtattagcttagctgatttataaaaatgacatatgcaatatcattaataaaagaaataaaaatatgtaaatggaaaatataaagaaaaatattttttaagaaatgacatgaagaaaaatttaaataattgagccatcaagattgacaacattgctatattttgcttcctggcagtcagagctaacagacataatcagttatttaatttattcttccttttttcagagataaaggaaatatactaccttgtaaacaaaacaaaacaaaacacaaggttttacattgaaagcattgaatttttaaaatgggaaaaacatattgtgaatctgaaaatataagttgtagctgaatgaccctttcagtgaagataaaatcacattggttcttttttttttaaatggaataatcatatgacactttcattgtatagctttatataaaagatagttaattaaaatttatgtcttcactgccagattggaagaccttttgtatggaaatgcatgccatatcaagtgtcatatctgtcttatgtcaagcctgtatccataataggtacaataaatgttttttagtaattgatgaaataacaaaatttaatgctaagaaatgcttcctggtattttaatcacatagcagataaatcagaagaatgtatgcagctaatgtatccaaaaagagaagtcaagtaggcaatggttattaaatcacatttctggatgtgagtaatgatgtgggtgagaataatatgattaacaatgccacagttctactcctgtcaaattaaaattttgcaaaaatcgtagagaatgaatcttacgtttaagaatttgaatttagaaaacttaagttatgagataaatgaacaataatggcactcacataatatttacaacataccaagcactcttccagtgcctcatatgttggaattaacaaagttctcacaatgactttttgggtggtatcattaatgctctcattttgtgaatagcaatgcggcatattacacccaaggtcatgtagctagcaagtgctggacccagggattggaccaagtctgattcatgagtgtatgctctaatcaggcttttattctatacttctaaaacatccaaacaattcactttattttttgtgtctgattattttaaattatttgcatattattcaatttccaggactattggaagtaataaacttaaatttaatttaacttttgatatgtagaattactgaactctgcttgcttttttatgtaagctttcttatgcattagatctgaataggcaacagaatttatgggagaaccaaaaccattctagggaagatatggaaaaataaattaaaacagaaggatttgagtacattttaaatgtgaatgtgatgatgttatgtgactaagatttatgaaatgttatattatgtgattatctttacctaacttatgatgaaaaagtagttgaacctctaagactttttcaaaaacccttatgacaaagaagtcagtaaagtggaaaaaggtaacactttttgttatgaatcaacaaaaataggggtatctggaacacttcgtagtctgtattataacactacaatccactatgtcaatcaagcaaaaagggatgtaattgttatgctgctgtgtccacaactgatgaatgtttgttgctatttgatggttggtaacaaattggtgggttctgctgtcagcactgctatcagagtacagttctattatattctcattaacataatgataaaattaacattaagaaaacactttctataagaatttatgagattctatgcaattaagcatgtaacagtgtggacagaaaatttgcagaaggctgtataataataaaaactttaaaaatatatttgtagaagtagtcagtgacctgagactttagactgttgatgactggcttgttgatatgttaatgtgaagtaattattccagtgaattgaagctgaaagtcaacatgtatatttattaatttagtttaagcttccttattgttaatcacagttgaggtatctattttcagcagacttatccataactttcccatcaaggtttgccaaccataaaatctaaatatttttttcctgtcaactttctaatttctaattaggaaatgttttgtgactctttaaaatcctaaacacttgtttgtctttaagaactgattttgtgggtcagaaatctgttaaatattgcatataatttgtcttttgatattcactaatattttcacaatatttataagcatgttcagttattaaaggattagatatttcttaataagtaccttttactaattgtgatagtgtgttatgtcagaaacaatattatgtgtttaccaaaccctccttttttggtttgtgactcatcctaatgaaatttcccagcatatcttatcgccgagtgggatcatgtgacctgtttctggatactggaatgttgattaaagtagaatatgccactttctggtcttgctcattaaaagaccttcctgattatctgccaagctctctccatctttcttctcacaccctgatgatgaaaatccagtggaggaccccaaagccctgaagatatgttgaagtgtaagatggaagtaacctagatcctgaatgatcatatggagcaaagtcccacagctgactactttggattatgaagtgagtgagaaataaacctgtagtgtttacactaatgagactttctgagtttttgttattgctgttagtctaccttgaccaatagatttgtgcttagcacaaaattggaagttggagaaaattaaaaacaaaggagtgtctccaccatgtgtatgtgtatttttgtagatagcaagttaaaagtcactatacaaggccacagtttatttgggtactattgtattggccaaagcaactctactatgaatgcaggaggaactagcaaaacaaagttaataaagagaagctgttcttcacttcaaaatttaatttcatgtctctaatcataatagaataagaaatgcagtcacctagagatcaaagcacacaataaatatagtttatatatatctatatattttatatatatatagatatatggagcttaacattctctaagcagttttgatgacacaatagtaaagagatcagtttttaatgcaatactatatatttctttctgattatcaggcagacaaattaacaaagagacataataataacaatcatattttgagtgtttctcaggtgcaaccataatttgggaccctattatatacattattctacttaatggctactaactgattttagagatattaaacaaaatcagagaggctaatttgcccacatcatgtagctctttagtactaagactgagattcatccctaggcccagcctactttcagagataatacactgttcattgtgtgagcagagaatggagttagtaagttaagtaggaacaagacaggataactgggataactgaaggtacgtgttccaaatatttttcctttattttaaaaagttgaaatacatttcagttactctgaacattatcaaagtgatataccaagtgtttcctattatttcccattttcacttgtttgggctaaaatgtctgtatatttttgacattattgttgtaattttttctacatattctatcctaatattaaccactccctgaatattgtgctggagaaggtagtgagattttaaaataatcataaatgagaataagataaatgattaaaacagcatctctattacagaatgaaataaagattatcaataaagtctataattatttgataatggagtttagtatctgtgaatgtaaaacgactttataatgtattatgattcagattttcaacttaaggcacattgtctctgatctgtcattttttactgtggtgagtaaattatcataactatatttttggtcaattcaagcttttacagtaaattttgaacatataaattatttaatacaggaatagggaaaatgaatccaatactcagaaataaaaatgaattaattagaacatattagaagtgagctttgcagatatctattctaaccacttcattttacaaaggaagattcagagacattgagtggcttttctaaaatgtcactgataggatgaactcaactacaaaatctagttcctttgtccccatgatatgcccgctctctccaatttgttgtttgtgtgtactgtgtggccactgcatacctttgagtgactttatttaatttccaaataagttataatggatatttgactgggtgtcatgttgttcatgtgggaataacccaaaaggcccagtgtgtctcctctaaatgcccatttggagttcctgttcatccctgattcatttaagcaagtttttctgtttgggccagattctagcctccaatgtcagggatacacctgagcactgagaaacttcttgaaggtgtaactttacttttaggtttctgtttagtaagatctaaatagacattttactttttggaaatatgtggattatcaaactctaaaattctttacaacatgacactttgatatttacaaaatcttcctgagtttaatgcaaaagattgattaaatatcttcttattttaattttatttttgttggattgtagttcttttatcagacagatctgtattcagtttcagctctgccacttactattttgactattcattgacaaatatcttaactactctaaatttcagtttcctcccaaatgataaggaaacatctccctgctagaactctttatccaaattgtttggcctatcaacttactcgatcagtgaaacttgccagaggtgacatctgggactttgatggctaggtcatcagaagccttgccccttttctctggacttcttggtactcagacactctctggaggcactgagccgccatataagaaacactcatagcttgtgagctgcatgttggagagccacatttaggtaatctatctccagtatctgatgagtcctttcttccaaccatcctcaggaagacaccaaacgtatgagtgaagcaatcttggattctctatcccagactgtccatatcagacacagagtgatcttagtaaatgctacgtggagcaaagcattgttcagctgagtcctaaccaaactcctgacctacagaactgcgagatacaataaaattattgttattttaacccattaaatgtgggtagggggatagtgtatgacaacaacatttaggttgaaaaaatattcctaaggcccaatatattgtaaatttaatgaagagctgttaaaggatacaaacatccaattatgtacaaatacgattaaacttctgtgcttttgctattgtgaatagtgctgcaatgaaaatatacgtgcatgtgccttcatagtaaatgatttatgctcttttgggtatatacccagtaatgggattgctgggttaaatggtagttctgtttttagctttttgaggaatcaccatgctgttttcctcaatagttgaactaatttacacccccaccagcaaagtataagcatttccttttctccacaaccttgccagcatctgttatctttttttttggctttttagtaatagccattctgactcatgtgagttggtatctcattgtggttttggtttgcatttctctaatgatccatgatattgagcttttattcatttgctttttggccacatgcatgtcttcctttgaaaagtatctgtttatttatgtcctttacctaatttttaataggatctttttgtcttgtaaatttatttatgtttcttatagatgctagatattacatctttgtcagaggcacagtgtgcagaaattttcttccattctgtaggttgtctgtttacttactctattgatagtttcttttgctgtgcagaagctccttagtttaatttggtcccatttgtcaatctttgcttttttgtgattgcttttggcatatttgtcattaaatctttgcccattcctatggtatttaccatccagaatggtatttcctaggttgcctttcacagttttcatagttcgaggttttacattaaagtctttaatctatcttgagttgatttttgtatatagtgtagggaggggatccagttgcaatcttatgcctatggctagccagttatcccagcaccatttactgaatagggagttctttccccattgcctgtttctgtcacctttgtcaaagatcagatggttgcatgtgacattatttctggtttgtttatcctattccattggtctatgtgtctgttgttgtaccagtaccatgctgttttggttaatgtagccctgtagtataggttgaagtcgggttatatgatgcctccagctttgttctttttgcttagaatttccttggctatttgggctcttttttggttccatataaatattaaaatagttttgttgttgttattgttgttctgtgaaaatgtcattgggagtttgataggaatcgcactgaatctgtaaattgctttgagcagtatgggcattttaacaattttgatttctcctatacatgatcatggaacgttttccatttttttgtttcatctctggtttctttgagcagtgttttgtagttctccttgtagagctttttcacctccctggttagctgtatgcctaggtatttttttcttttgagggtaattgtgaatgtgttttaattcctgatttggctctcagcttggctattattgatatataggaatgcttgtcactttaatacattgattttgtatcctgaaactttgctgaagttgtttatcagctgaaggaactttggggccaaggctatggggttttctagtatatggaatcatgtcatctgaaaacaggtatattttaacctcctctcttcctatttggttgccctttatttctttctcttgcctgattgctctagccaggacttacaatactgtgttgaataggagtggtgagagaggacatccctgtcttacgcccttttcaaatataatgcttccagcgtttgcccattccataggatgttggctgcaagtttgtcatagaaggctcttactatttcgtgatatgtttcttcaatacctagtttgctgagagttttaacaagaagcgatgtttaattttatcaaaagccttttctgcatctattgagataatcatgtggtttttttctttagttctgtttatatgattaatcatatttatttattttcgtatgttgaaccaaacttgcatcccagggatgaagcctacttgatcgtggtggataagctttttgatgtgctactggattcagtttgcaagtatttagttgaggatttttgcgtcaatgtttatcaaggatattggcctgaagctttcttttttcatcatgtctctgctaggttttgatattgggatgatgctggcctcattgaattagttgagaaatccttccgcctcaatttttggtaacaatttcagtaggaatggtatcagctcttctttgtacatcaggtagaatccagctgtgaatctgtttggtcttgggctttttttggttggtagctaattattacgaattcagtttcagagatctgttattgatctgttcagggaatcagttgcttcctgcttcaatcttggcagggtgtatgtgtccaggaattcatctgtctcatctaggttttcctgtttgtgtgcataaatgtgttggtagtagtctctgatgcttgcttgtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggggaaaacaactttcctgctccatcccccttctggcttccccatctgctgagagctacttttactcagtaaaacgttgtactcattttccaagcccacttgtgatctaattcttccggtacaccaaggtgagaaaccccaggatacagaaagccctctgtccttgtgataaggcagagggtctaactgagctgactgagacaagccatctactgatggctaaactaaaagagcaccctgtaacacaggctcactgagacttactgccgaggggtcggagccccaaaacctgcctgtatgcctgcgctccctaggggttttgagcagtggggcactgaaggcaagctacactcccatcacatgccttgcaaggaggataaggaaatttttctcatttcaataacttatcaagtgtatagagaaaggaacgacaactattcaggtgtctgggatcagagtgttccagtttgacttggtgatggtggggttaccaaagaaacaagtatagaaaattcaccattcttgtatcttccaatcggccaggatccttgatcattataggtatttaaaggttgaatgaatggttgaataaaagcattagtctcctactattactactttgcaggtttctatatagattaatattttaattttatatatgggcatttacaataagtaaatgtaatttactttgtaatttacattacaaaagtgatgttttcattgagcagtattttatactgggagaaaaatctgcctgaatattcaagaagtaaatagtagtgagaagagctgtttgcattttcatcggccttcttaaactagctttatacctggggtccctgcttttattcctactccctttcataaccgagtcatcctggatgacaatgtctgtttatacttttgttatacatcacttttcctcatttcatttcttggttgaagaccatatgttgtttcctgttgcttactggactgagtctgtacttatctacttttattaaaaagtctttcataagctaagcctgttttctctaacttccatgaagatagctattcgtaactgactaatttctaacttctaactaagttatttctaacttcatgcttgtcccctatacaaagtgttttatcccttgtttgcatgtttttaatgttgtttctatttgtaatgtacatctccaatctttttcagagtctatttcatgtccatgtcttctattagaatttacttgattctgatgtattagggaggctgaatttctagagaataaatatagcatatgccacattatttatcatttttgtaaatgttacattttgtcattcctcattgtttttctgcattttatttcctcaaatagatttttaagttatttcagcctaaggatctcattgtagttttaaagtgaaattatgtgttatatagcttagatattttaaagcaattattcttgggttttcaaatgaaactacatgatactattctaagtgctagaattgttattgtatataagggacctaagttactctcactaagtttggcctccttcaaaacatagcaggataccttttcttatccctgagacctttataattctagctggtactttccaaatcatgcagtgccaacacaggtaaattgcatactaggtagaagctgtcaggatgttacccaccacaggaagtagtagagaaagagtgttaggggaaagtcagtggaaagctcagtaagaaaaggaacacatgaaaacaatatgctggttattatcaatagttaaaaccaactggatagcaagtgttcccatttaaaatcaatcaatggatgccaaaatagcttagtcagcatgaaccattgatatttgcagatttcattcattccagccctggtatgggattggacagaaaacaacacagaatgagctgcagcaaatggcacaatctttattgcattatataccctatatgcctatttcttcaaagtacaaggcattgccaaggaaagtacataagaaaagaacacaatacttacgtcaaaatgtttgtgtaatgcttcattatgtgacattacaaagtcatgagatctaagagatgaagggacgatttttcagtgacccactccatatgcttctggcagaagctactgcttgagaagatacaggcagaaaattcatcatcttacaaggtagcctatctcatttttaatagctttattctggtggacaaggtaaacattaacaagctaggacatttctggcactgctgtcattctctttgggaccttgacctcacttccaaatacttccagttattattgagaattttcaggtgttaacatgtgttctaatgattatagtttacagctacagtgttgcagtcaacatttaccattcttgctccagctttccatgtagatgttcaaagctatggtggacatcaaatgttgcagccattccagtggcatgtacaacactccagggactgagcagagggcagccagagtgacagatggcaggctacactcataaccacctctgtattctattgcacttgcaacaatcttttgatgttattgatttcttgccaagtttttcctattaatgtaagatgcttgagagaaagaaccatgatttatttgattcgggttataaatatttttgaatgaatgagtgattttaagcattcatccacagctcaaactatgcaataatcactttcctttcagtgagttctttacctagagcagactgccttgtaaaacatgtaaatggacctctcacagtctaactttttatagacatgcatgacccaaatttagggtgaagactgtttaggcttaaggtgtaatacttgctggattcataagttagtgttgttatgaaacacaactgtctctcatgggcctagttcagcccagtggaactaaatagaataaatcttttctacttgcatgggaaggagagttgtgttaaggatttatagcttcatgaagactttcaagttaaattttaaagaaacttgaataaagcaactgtcagtaactgttgcttggagtgaaaagtgaagacgctaagagctgctactttttcagcttttataaagtacagagttgtttttgtgctggaagcaggaagctaggagcagcacggtgagaagcacaaaactccgagatggagatgtcaagaagatgtgcagtattcatttattcattaactgcagaatatttactgaccaacgacaatgtactatgacagatgctgacagcagtaaacaagatggacagaggctcctgaccttatgaagatatggcctagcagaggatagacagaaggttacacttattcaaatcactaatggtaattgtgacaagtacagaagtgatcatatggtaacctaacaatttccaccaaaataatcaccgggattagaagggctgggttatatgggaggcatcatatcaagaagcatttcattttctattgatttaatgaaatcaatagaaatgagaatgaaaagaggtattaaataacattgaaatactcttttctacatttcttgccacttggagaataaaagggtaaattaacttttcaaaaaaatcttcagctatatggtttagatactttgcatattcattgcattttaacaccattctgtgaaaaagatgaaattattttcattcatagggataaagtgactaaaatacttgtagatgggggtggatgatgggcacaaattacttaaacatggtaatgatagggcctccataatggtaatttaccatttacataactctcttttaggagaaatttcaggtaccagcccagagtcgtacagctaaatggcagtcagaaatcaaactcagctctgtttgattgttgtgtctgattcactttcattttaaaaactatttttcttgccaaatcacattgttctaggatttcatttattatgattatttttgttattgttttaatttaggaactcagaaatgttagattgccagtataactccttcattttattatattatttatttatttatttagagacagagtctcactctgttgcccaggctggagtgcagtggtgcaatctctgttcactgcagcctctgtctccagggttcaagcgatcctccctcctcagcctcccaagtagctgggattacaagcatgtgccaccacacccagataatttttgtatttttttttagtagagatgggatttcaccatgttggccaggctggtctcaaactcctcacctcaagtgatccacctgccttggtctcccaaattgctggggttataggtgtgagccaccatgcctggccatctttcattttaaaaaggaaaaacttggaattcagagagttaatgtgacttgctcagaattttacagaaattagacccaagttgtcaaaatttgcaggaagtactacaaaatatgtgattattacctatactaatatttaaatagtttatatcctagtgaaaggcaatatttttcttagaaattttttcactatagggctttaggaaaaggtttaaaaagagctttacatatgaaaatgatactgcctagtgagcatcctcaactcagcaaaactctcccaaactcagccagggattaaaagctctgacttacacacctaagatgttttcatcatgtacagacttagaggttattttcaacaacaacagtaattaacttacaaatgtggaattttcttataaaaaatttggcttttattcatgaatttcttcattgcatattataaaatatatccactgaattgagtttttgagatctattattgtggtgttcatttattgtgtgaattttttttgcaattgtatttgacatgtacctggttaagtacttgttttcagcttttagcataataagcaatatgtgctatcatagcttcaattttcctgccaagtagagagtgacagctgtgtggcaatatctaatgcatattttcatctacagataaattggaaggaaggaaaaacagcttctgggtgggcaggtcaccatcatttaaatgaatcgttaaaattatatttttccctggaaacaaaatgtaattgcttttctgcttagatgcacactgaaagcccttatttatattattgtaacatattttctcacaatttacaactttctcaagatcctttggatttttttcatttttgttactttcctccattcaagcaatgtacacttatatcttaataaagctttgtgatatttacataaatttattcctgaaggacattgttcaatactcttccacattcatttgacggcactgaagcaattaaagccctacattgattgccacttcaggaacgttctcatgctcaccttgaatgcagaaaggttacagccttgggctcagtatttttaatgtgcaatatttttactaaatttcaaagaaataagaaatattatttatctcttttttcattttgtaattttagattttgccactaattgtaagacatttgcccatctccaagatagcatgaatacattcactgtgtttccaaattgtgttgctgcctacaacttaaaattatcttaacaatgattcatgtagtaatatgaggttcataaagatatagtattcatttaatgatttgcataaataaaaaacaaagacaattttcatctctgtttcttctgctctcaatttgcttgtatataagtgataatttggtattttatgtgctggtatgcctttattttgagacgttcaaaaggttagcatgggatagtaatttatgtgaaagctgtcacttattaaaacagtacaaccattcatgagttctgtgatactctgagtaaatctaattccactttagactttgatgatgttatttgcaattaaagattctatctctggtgattattactacaatattttggcttatctgaccaatcacaaacttgaggacattagagaggggaagaaaagccaagtgctatttttctagagtttacttagggtttaaaaattttgttgtttcaaaggtgatagtttctgttgtatcataagcacatgaagaaagtcgattttgtatgtgaagtttaatcagcatagcctaagtttctgtctgaaatgatacactatgagtggttttttttttctagcctagtatgatttaatgaaaattttagactattttttgcccaagcaatatttcttaggtcttcgttcagaggattcatatatggatctgtgtctattgctaataggcttcttaatgtatactccttttagttttttcctcctcttgaactttgtaccatacagctagtatcactgtctcacctaaatcattgttattaccagtaagtgataggatagtctctaaatttccttgataactcaggtatttccttaataactcagaatcattgtttttctatcaggtcatgtttgtgaacctaagagttcaacactcacttgttttttctaatttattgtccttatacttctagcatacttgacttgtttttagttactcatttcacagatattagttggagtctctgctatgtgtcaggccctcaactcaactgcttcagctgccctcaggctcaaccttgtcctgtagataatcatttccccgactggtcatatttctgagttattacattctgaaaattacctatattaccattgtcttcactgtgatttatactgttttagatcagattccttgggaaatagacccttaaccaggatttgcattcaagaaacttactgggaaatcctctagtgaataacatctgtgagggagtaaaagccatgtaactgagcagagtgagatgcagaattgagatgcagttgccaaaaaagactttacccatcctccacagattgctgtgaagctaaatggcagttcagaaatgttcctaactgaggcaaggaaggagcctaactggctcctttcgtcgacaagtcatagttgtgggctacaggctccaccttgtgtgaacagcccccactttggtcaagggcaaggcctaaggaaatactcagctttgtgtcatcagcaggcaacactctttgcagctgaaataatgaaggcctgcatccccaaagggagaactgggtggcataccagagcacccacaaaaaaaagtctttcttgcctttttccttttttcatccagaagtaacattttttacttctctctctccctccttctctctctctgccttccttccccataaaggctatattgattgcatttgtcattgtcatgtaaagagttctttcaaaaattgcctagtagcaagaatgtcccacagacttttttcttataattcagctataaggaaaagaaaaacaaaaacaatattttatgcatatctagtgttatgagagatatagtgaggaatttgatcacttttatagattaagtctagtcatttcctgtcctgaattacagcagaaatattactagctttgcttggggtatcttgggatagatggccagttcctgatcacgaggaggaggtggttactacctctaccataacatgctgctgctattatgctattcatcagaatacaacagtaaaaactggatttagcagaagtagtggtatcacagaggagccccttggtgaacaagacctcttcttctttatacttccaatcatgccgttttaaatgctaaccacatttaggagagctttccacatgaaagacttctaataatatttaagttttgtttacataaaaatacaactgaacatttttatagaaatttagtaacaacaaattactactttataaattgtaataatttcttatatttaaggacttttaatttcaccagcaaatatggctaaatttactgtatcattagagttacttggttaagttatacattagcattacctgattaatatctcttcccatggttatgccacaacaaaatcttaccgcactcaagaacacctggttatataatcgtcagtgcttttttattatttcacaattttattttggtgttttgagattttatataattttatttttaaattgtctcttctttcagtaaatataaaagaggataatcagtctcctagagcttcccatttaagacatatatagcattcttacttagagctgtatagcttatcataatttccttcattaaggtcatattaaaagaaaaatgtcttttttgctgtgagtccactaattcactcaacaactattttgtagcttctgttgtgtacataggagggacaaagatgaataagttgcattgttttttctctcaacattctcacaagtgtaatcaatgataattatatgtaagcgatctaatacaattgtacaaatgttctctagtactgtgaacagtgctattggcagcagtaaaaacagaactaactcttaagagtggatttgctggaaaataaagttaatgaaggagtcatatttgagcagatcctagatagacaagcctgattttgtatctgcatcatgagtgtacatgaaaaagacttgcaatatagttggaaaataggctacatggtgtgtagcagactgtgataggacaaaaatgtaagtcagctatcaaaaggccttaaaataattttagtctgtatttaatggatggctatgtagggatttttgttttgttttgttctgtttttgagaaagagggcaacttaaatacacctttatttcagaaaggaattttgggtcatattacgtagaacagatgatcagtgggagcctaaatgggagggaatataaataaaccaaatatgagactgttgaattaagaagaaaggtaaggaaaactatgagatataattattaccaggtgaaagaaaaaaaatgtagaagaggagaagtggggaattactggagtgaatggtgatagtgtaactaatgtaagatttgcaggggaaggaactgagagtggtaggaaatgttaatttactttaaaaatattgtcaccttccatgtgactttggcagaaccagatctgtttattctatatgaagttggaaatttgtatctgtaactcagcatcataaatatggaggcttcagctccaataattgaaatggatgagaatgcccagagcaagagagggagagaatggagagaatgagaatagagagaaaaagagttgggaatccattatattttatgttttgtggatgtgtgtccctttatgtaattgcaatcattgcatacactcatttaatattatgccctaaatactttactccatattgttatagaatgagaaggcttttaggatgtcggagttaagaatattgtggggcaaaataacatatatgatacgttattgaaccatatcatcatcatgtgaaaagcacttttaaacaaaatcacccttatattgcctaactgcctaaaaacaaatcatagtacttgcagtgtagtttcaacaggtgataattatatgaaaagcttttgatttttgtcccaaaggcaaactgaagataatttagcactgagacgtttctttttaatttcctttaatacctaagaagattttcttctacagtgaaagcatgaatgataaagggaaacaaaaatgaagaagcaaattgtttgcatgtgtcttcttttaaaacactggctaatcctaaatattttgttttcaattagagtatcgtgatctttgtttacttcctccatctttattgaggtataattcacaagtaaaatatgtatatttttaatggtatacaatgtgatgttttgatattagtatacattttaaaatgatgaccacagtaaatgaacatatctataacttcacatagttatatctgtgtgtatatatgaaagaatacttaagatctactctaagcaattttcaggtatacaatacagtattattaactatagtcatcatactttacagtagatctccggaacttattcatcctaacaaaaactttatactctttgtctacatctccctttcttccactaccactgggaaccacattatattctctgcttctatgcatttaaaaaatattacacatgtaagtgagatcatcatgcagttcttgtttttctgtgcctacttattttacttagcataatgtcctccaggttcattcatgttgtgcagataacaagatttctttcttttttttagactgaatatttttccattatgtatatataccatttttatacatttgtctgtcagtgaacacttgggttgattccatatcttggatattgtgaatagtgctgtgatgaacaagggagtgcaaatatctcttggacatacggatattatttcctttggacatatatttagaagtgggattgctggatcatatggtagttttatttttaatattttgaagaatttccttaccatttttcataattatttattaatttacatgtctaccaaagtgttcaacagttaccttttctccacatccttgtcaacacttatcgtttgtctttttggtaatagcccttttaaccatatgaagtaatatctcactatagttttaattgttttttcctgatgatcagtgatgttaaacatgtttcatatacctattggccatttgtatgtcttcttgggaaaaatatcttctgaggttttggcccatttttaattgagtcatttgttttcttactattgagttgtttaagttcctagatattttggatatcaacctcttataagatgtatggtttgcaaaatttttctccattctctaggttttttctttattctgttgattgcttcctttgcagtgtgtaagattattagtatgaggtaatcccatttgtctatttttgcttttgtcttttgtgtttttgaggtcttagctataaaatatttgtgtagaccaatgtcctaaaaaatttcccgtttccttctagtagttttacagtttcagtatgtttgcatctttatttcgctttgagtcgatatttgtatattgagtgatataagtgactaatttcattcttctgcatgttaattttcaattttcccagcaccatttgttggagagattgtcttttcctcattgtgtgttcttggcacctttgtcaaagattgattacctgttaatgaatggatttatttctgagctcgctgttgtgtttctttggtctatatgtctgttttaatactagtaccatgctgttttgattactttatctttgaatcaagattgtgatcttagctgtatttgtttgcaagcaactgtgcatctaaatctcacaagatttcttacactagaaatgaatttggtcataagaagaaaccaagtatgaatggtgcagcataattattttattcttaaaaaacaaatcaaaatatatttcttatatgtggtagttcatatacaaagaactctgtatcattttttgctatattcagttcctttagtgtttggcacagtgtaatagtgcaatgaatatctctttaaaatcatccactgaaaagagaattatattttgtaaacttctttttgatcttcaaatactatttgaaataactagcttactaagagttgaaattcattaatctgaataaaatcattaaatgattatatttcattaagatttaatttttactgaagccagagcaactttatatacaaaagattatttcaaagtctcctggtgctttggaccttatttcagagaatctgtcaacttctgattcagaatgctatataatctgtgtgcatgttaccaggacacgtgattgaatattatttgtctttttttttcatgcttttgctctctggttcagttttggagactttcactcataaatattctataatcagaatttattttatttggaaaacaccttaaaaactacctatctcatcagctgtctaatgtgtacagtatgtttgacaaatgttccttcaatctgtacttaaacttttggagactgataattccctctttttttgaaatatctcaatataaagatcttacctaacatacatcttctcttgcctagtcttaacacattagttccttttctgttttttgctaagtggtttccagtttcctcaccatattcatttcagtttgaggacctactaggatccatttgtatagggtagaacttgtatatttaagaatcacacaaatatggctaaagtcctatttccagtctatagtacccatgatcttgggaaaattacttaacttccctaatattcaatttttgcatctgtaaatggtactagcaacaaatatagaggctattgtgaagattaagttagaaagtggctaaaatattctgtaaaatactctcgtagtttaacatattttcatttcctcctctgacttcctatgtttacaagcagatcgataccatctcttcaaatgttctagattctactaagtaatatgaagattgcatcagctttctggcagttttttggcctatttactcacaagcctctatcaagaaaaatttaagtcatttttgtacaagaaatgctagccttcatatcaataccatatatatctttgggcccagctggttaagccatgtcttagaaatttattttagtcagccattggtgttagccaggctcccaaatttgtcttttgccaacttgattatcacttccaattaatcagtgacaaaacactgaaacaaagcaggacaggagcagacccaagccaggctactaagaaactatgcactaactcattactctgcacacttcattcatacaactgcttccaattcatcttactttaccaggatctaatggatatttctctaggtgcgtgttgcctacaaaattattatgaggaacactgtcaaatgtcttgatgaaatagacaaaatgattctacctgtttatgcctctgggcgcaggttggtcaggtccatcaactagtgagataggaggcagtgtctccatgaagaccagaagcaataaaaagctgagcacagaccagtctcaatgcagtctcaaaaatcaaagccgcagaaacttcaggtaccacttacaggaagagggctaaaataaaagggcaaatcagtagcttaaaaagaaatggaattggagaagatgagacagaaaagcaggaggattctgagtgattactatgaatgaagaaatggaagtattaatagctttgttttgcccgtgtaaatggagttgtctgaacttacggaaaaggcaggcaaagaatgaacatataattgttactcatgtttttgtattattttagttgtttactttaatctgtcaaatggtttatggtaaactctgttggatgcttgtttttgtactcttcctctgcagaagctctgaaatattcatatgtactatgtaatttcattcaggatcagtataaacccagttttaaaaattcacctttgccctccttttgaatgctgagactcatttgctgaattccggagttgcagccttgtctcataatttcccaaaagtcactgataaaatcacatgaaattttcccttgtaacactggaatatagtttgtgtgagaaaacttgaactaaagtagttagttatcttcttatgattccttactgatttgaagctcaggttccttctaggtcaatgtatctctttggctcaaaaattattctttctactgattaatcaaatatgaatttagatgcttcacttctttttaatttcataaaaattagtaccttggtgatgtgtacataccctatttcaaatttatcatctgtatatttttaagataaatcataacaaaattctttctcttctagaaacagtaattcttcttagaaacttagtacaggtaagttttataaaacttgatgggcagtttttttttaatttaaaagtttataaaactttgtgtggctattgattgtacttagagtaacccacatttgcatgattagggaagtacaaaagcttaaaagttaaccacttccctgctaatgtagaaagacaagttgataatggactgagtcaccacttcttctaggcaactgctaacatgaggagtaggtttaaaaaattaaatttcttagttaaaaaaagggttttaaaagagtattgcttactgtcatgtatatgtttttaaaaattcctatttcttttatgtttgtctcatagcttatccttaagctgagcaaaattattcaaatgtgttaaaaagaatgttattttctagatcataataccatgactctatggtctggtgggatatgtgaatacaacgatgagtgtgtttctttcccttgaaccaaccaaataaggttttttggcattcatgctatattaaaaggtataaacataaataatgttatagtgtaaataaaataatgttatagtgtaagtaaaaataaacactggcttctaaaaaacatttaatatatgaaaaaaatttaatattagatgacaaatacttctttttaatgtttattggtgaaacagattcagaaatgttacgttcctgccaagatcacacagctattcagagaaaacagaattaaataaaatccatatccttttcaatataattaaatgcttcaaatggaagatataccaatttctctcttcccactgtttcctaaagcatgaaacctgtcaataccacccaaactcatattattttaagaaagtagtttccaattattttgagatcggaatcctttagagaatctggttacaaaaactgtgtaccctttcttcagaaaaatttacgaatgcccattcccaagccacatttaagtagtaaccagctgggcggttgtctaaagtgctaatgtaagagtagcactaaaatgacgctagaaatatgttgagatagaagaggttgtcttacaggaattcttagagataatcttatatgtaggtggaagttttattttcaaaagcctcttgggatggaagaggtgaactcaaaaattagggcttcctctcactcacatgtcactttggtgtacactcctactttctggtggatccagttgaacatattggactgcttcagattccaaatacaaactgtttttacaaaaccacttgtccacttggctgggtgccattgttaccacgtgatggagaccttgctcaaaggcagacactcatggagcactgtagggctatataactgctttcccaagaggttccatccagttaactgcaagatttaatttttactgaaaggagtatgctagtgtaggactgtaatccagaataaatgataaaggatgactattgctcccagtgtcccatttctttacttttcctaaagcaaaagtgatctgctccagttctaaaaacaatgctggacagatatattgagaatatattgaggaacaccaagtcaccagcctacactgcttttcaaactgaatgggatgctttaggtgtcttggtctggtcccccatattcatcacatttatttttctacacattttcaggggaatttataaccacttgatgcttatagatgttattgtatatgtcttcattaattattcaatgagaacatactatgccagaaattaaacttgtttacatacgtgccctcaataacaaatacagtagaatgattaccatatttgataatattagattttgtttaaaatctagaattactataaaattcacacaaagccatgttacatattttgaaaacaacacaaagaattggaaacttcagtttggtccactctcatttgagctaatctcagttgcttctatggtatcaacaatcgttgtgcttgaggaagacatcagcttgaattttgcatgtctctgtacattaacaatatcatctcaatgacacagtcacaaaattcctacggttttctattgaattacgtgtatttttaagatatgagattgttttaatggatctcagaatcacctgttatacatcatgttggtttggtaagcatggaaatctattgattttatatgttccatttttctactgagtagataatccttatataaatcaaaatgtattttaatagaaagaaaaaaacactacaaatatctctgggccaataaagttctcttggtatcagggaacttgagtgattcattccaagcttgtacgtatttcattgctgaatacttaccaatgataaaaagctgaaagattacaaaagattgtatcatccagatagagaatgtgtttttgtcaccaagagccttataagttacttctgaagagtgttaattgtatagaattctttatatacaagccagtgaacatagaaaatccataacctaattatatgattaaaatatcaaatataaacatgtatgtgtataaaatatatgtatgatatgttgataaggcaaatcctgctgttttatgaaaaataaaagaggtcatgaggttatttaatgttggagtgtttgaaaaaatatttataataacactgttttgtttagatctctttgtatacaaagcttgtccttatgcatatgctgatttcttctcagaatattattttatctgatttatatatagttataacctttgctgtttttaggtttatcaaagagaatactaatatatgtgattttcatttcatcacttatccaaaggtaaatgaaaatcacaaattaggtacaatctacaatatttttgtcagtttaaaaatgtaaaataatagcacatgtagtggtactattattcgtgttaaacttgagttgcactgaagcattattttctttaaaaattcagtaatgtatttaaaaatatacacgtgctgccacaatatatttccatggttaattattcatgtatacgatagcctagtttctcgccttttttgttcattgtatattcatactacaagtaaggatttttctgccttaagcagcagtccagtttgggctgtgtaatactaggattattggcatcgacatctgtctttcccttaaatttagggaatttaagccaataagctactcccgtagaaatttgaaattaggagcatagaaactttggcaatacatgtgtgggtcctggaaatgttaaatcatgtagaggtggagctggaacagccattttcatgaaagcatgtaaatgttaagttaatagagaaaatagtcatcaaagagaatcaaaaggatagtttgaattcatagagagaaagggtcaatagaccgttgtggattagagaaacaatcgtactgaaatcagtttgtttcacttcacagaaaccaattgctaaattttcaggaagttttgcatctggggtggcttcaagtggacaagtgatttgaaatcagccatagtgatgtacttctgccatagaacttatgctccaaatcagggcttcctgttcctgagagttgttaaacgtttagctgcatacattgtcacagagagggagagacagagagagagagagagagagatctcctgagtagtttatctgatccttgatagcttcccagttcccagctctaaatccatgagaaccagcaatgctttatttctatggaatgcatttgtatcctgttaataaaccaacatttatgttctgctcatttagttcccataaaaaattaattgctacatttctaatcaatataattggaagcaaggaaacaggatggtaacttatattcatgtgaaatgccttatatgtatatgctgaagtctgtttcttttttgaccccatatagtttagaatcaatcccaaataacatttaatgccaactatgttgactccatagcaagacatctttttccagatgcgtttcagtattaatctgatcatcaccgagaggaaacttagggaggaataaagacaataaattcagtatcttaaaagatatttgagtattttattaaggattttgcatttttaaatatagagttgtgatcaattttggccatcacaggcatacagaaaagtttgccctgaatgattagagaggcattctgtttaaaaaaagaaagaaagaaagaaagaaagaaagaaagaaagagaaagaaagatgttaacctggattatctttctcaattttttcctagtcttgctttcaccacttcctctaatatcttttagattagagcgaggttagtaaataccttgtcacaaattaccttaaacagactcactggtggatgttattttgaggagaggccaccactcttccttgtgtctatcccatcccaacctcagcagagcttctagatatagaaaaatgcaaaattcagtcattctgagacagtcccactcatcttggcaagacaaatgcagaaatgtgtgctctaccctaagagttactaaggcctagtaacacccacaggggatgcttctgcctgtcattgttgacctcagaaattttaaggttaggtatcaaatgccagcaaggggcatgagcagttccagatctatcttttgacttgctggaagcataattactaaaatacagtgactggcccacttttttaaggcctcacaaattttaattgggagcaccttgacccccaagtacaaaaggaaggatttcacctcataggaaaaagtcaagcaatattacttagagaaatgcaggatatcataaaggactcttacaaacatatgtgcctttgggctatcagatttaaagacagaagaaactaatgccctgcttgttttgtgttatttaggaaatgccaccagaagggaccattattttcctctttgaactaaatgtcttaagctgtttcaggacaagcattaacctttagctaagaaagaatttatttaggatatatattgaaacacacttctattgattgtttctggcatattgcattaagtacagaatatttctatagaagcagctcactcagttcaacaaggttatttttttccagttatgctaataggaaatttaaatattctactaccatatgaatagataggaatatttctataaaatttaagatcacatctgttatcactatacatattttggatttctttttcccttgaatgcaagaataagtgcagatatttattgagaggaaacatggagctgtttgatttgtctctggcttgttaacaattaaagcagattattttttggtatcttaatttttctaaatatagaatatagttaccaggttattctctccttcttccaagagaaattgaaaaatgactaaaaattctttattattatgtggataaataaatgatttaaataaaataaatattttcagacaatagtactcaaacgtgtttaattatcagttaaattacaggttgctgactaaatagcccaggagatagtcttaaacacacacaacactcctctttcactgaatttcaaacctagttttaaatgctttcagattgttttagagtattctttttattgtaataaggacataagtaaagaccattgatgtagtttgtctttgtagaagactgagaaatgacttcgatcagaggcacacatcccactgtgctttggtttagtgaatagattacaaaatgagacttattcaagatcaaatggcaaggaggcgagtattcaagtctgtgattacaagacaaaagcctatcttgatgcaggtatgcgatttcctactactttagaaggcatttttttagccttcacagtattgctgggctcttaaacatttggaaagttactgcagtttctttccttgacctaggcttgggacttactgatttagacatactggccatattaacaagttgttacccccacctgattctaatggccaggggattgtagttctcttgtctcagaatccacaacatgcactggcagcttggagcacagcccaggaaagctaactccaggtgtaaggcttcagcctgcattctcccagtgcagaagaaaacagtaattttcccacttttctgaacagcagtttcaatccaaaagcacgatgaaaaagtaaaatttatccaagtactgctttattcttggcatttagcacaaatgacaatataactccacaaaactacttccaaataattacatgaagaagcatagtaagaaacaatttattaacatgtcactactagttttctcctaggaatttagatatgccacaccaaaagatgacaaattaattcccattacactaaacttctactaggttcttatgaatgttacatttgttctcctttgtactctgcactaaggaatgatggaaacttagagccttcacctgtgttaaaaaaaaaaaagatttgaagtaataatacaggagaaccaaattaaatccatttgaactaaaactagcatattaattcagttctgcagatgtttaaatgtcaatattagtttattaaaaaccactacagtaagagcataaagaagatggaccaatggaaggaggcaaagggagaaggtgaaaaaaaaaaaaaagaacacttagatctaattgagaaacgaaagaaaaaattaaaactgaagaacacaataacaaggaaaaagactgcagggtagggagaaataactttttctcacccatcctagattcatggctgaggtccctagaacaaaaaacagattaacaagagaaaaacatacaaattcatttaataagttttacatgacacaaaagccttcttaaggaaatgaagacccaagtaatagttaaacttgtgtatttttaaggtaggtttgctaagagtggacagcagtcagggagaaatgtaattgtacaaagggatatgatctaatggtaataaactgggagggaactttgcaagacctgctttgctctggatttctggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatagatgtacagacatgaagtctgagattttagtgcacccatcacctgagtagtgtgccctgtacccagtagtcatctttcatccccctcttaacctccccacttctgagtctccggtgtccattataccactctatatgtctttgcatacccatagctcagctcctacttacaagtgagagcatgcagtatttggtttttgattcctgagttacttcacttaaaataatgctctccagtaccacccaagttgctgcaaaaggcatgattttattcttttttgtggctgagtagaattctatggtatatatgtatcatattttctttattcatcagttgatgggcaattagactgaatccatatgtttgcacttgtaaattatgttgttataaacatgcatgccagtgtctttttgacattgtgacttcttttcctttgggtaggtaccagtaatgggattgctgggtcaaatgttggatctacttttagcttttcatctgctcttaggcctagctgttggattataatacttgatatctagctttggggcatagaagcattctaaactctagacactgaaaaatgtacattttgggggattttttttggagacagtgtctcactctgttgccctgatgactatgcaggagtgcagtagcatgatctcggctcactgcaacctctacctcctgggttcgattctcatgtgtcaacctcttaagtagctggaaccgcaggcacagagccaccacgcctggctaattttggtatttttagtagagacagggttttgctatgtatgttagccaggctagtctcaaactcctggcctcaagtgatctgcccaccttggcctcccaaagtggtaggattacaggccactgccggtgcctgaccccatttttaggtatttttacacttttctttcttctactacctgaatttttatgtctttttttttttttttttttgagacaaggtctccctttgtcacccaggctgaagtgcagtggtgcaacctcagctctctgcatcccctgcctcctaaactctagtgatcctcccacctcagcctcccaaatagctgggactacaggtgtgcaccaccacacccagcttatttatatatttttttgtagagatgggatttcatcatgtcgtccaggctggtttagaactgcccatcttggcctctgaaagtgctgggattataggagtgagccaccgtactcattagaatcacctgtctatagtaacacagacatcacttcctttgtgtaaaaaggtacagtggtggggccaggtgcagtggctcatgcctgtaatcccagcactttgggaggcggaggtgggcagatcacgagatcaggagatcgagaccatcctggctaacacggtgaaaccctgtctctaccaagaacacacaaaaaaattagccaggcgtggtggagggtgcctgtagtcccagctactcaggaggctgaggcaggagaatggtgtgaacccaggaggcagagcttgcagtgagccgaagatcgtgccactgctctccagcctgggcgacagactttgtctcaaaaaacaaaaacaaaaacgaacaaaaaaaaaaacaacaaaaaaaagtacagtggtaaattcggtgttaattatatgcattactgttaaaaacaattttttctgacacttcttaaaacagtaaggcactttattcaggattatagtaataggtgaaggaatactgcagtggagttttgcagtagtagagagagactgggctcaagtctgtaaataagaaataagggaattcataggcaaggagcagcagggttggggagttggtacatgtaaaattgctgatcaagtagagtaattcttgctgaactgacctatcaggatttccacagaaggcaggtcagggtgatcagacattacctgagagatagtgagagatgagggatttggtcagatattgaagactatcagatattgagggtggggcattctggctaaactgatacagcattcttgctacatttgggttcttgagaaaatgccctagtggagctcaaggagattaactagagttaggtcaaggaatagtctttgtcagtacaaactaaaatggaacttcaaggtctctcatatgatcaaaataaatattattaagtatctgtcaaagtgcattttgttgataaaattatttctgctttttactacgggtggtggtagtgacagtacatggaactattactcatttctgataacaacttttgatattttctctcttggattatgcacatgtctacagtattctgggtacccttcctacattctcttaccatctcggggttgtttttttctctttttcttcattttttctctagttaccatctgtcaaactggatatctgtcaaactggatttctcaattcttctacatatggtagttaaatccaatttgcttttattgtaaattggtttggtcataattcaggtttaatccagtttttataggatcatgttaatgattttgttttttaatatctatgttctatttaattatacaaatatttctagttgacacattttatgactgtcctgaatgctatttttgtcatttttctgcacctgttaaaatatatccatttccttaaacagactttacaacctgaattacaaaatttccacttatacacatcctaatttgtttcctaacctattgatacatctttccagttagacaagttatttagctattctcctgccaatatgcatattaattcatctgacattaggggaatattaaggaatgtagacttgaataatttgattacataaaacttctaacaagactatgcctattctaggctatgggtctttcctagatctgttaaaagtgaaaagcatttcacttattctaccgtgattcacccttattataaacaaaccatatcctagtgagaagagctaaatttgtattttggatgatatgttccgtgaagaaattattataattattgtattgtaaccacttctgtgccatttaattgacacaaagtgatctttaatcattcagcagttaattctttcattattccatcaggaaaaatcaatagcacagttgatttatatctgtagaaactctgatactacagtggcagattaaaattgtcatagcagagaagaaaaagaactcgtatttagaaaaggaaaattatctaaattaattccacaagtgcatgctttgcttaatttttagatatataatgtaaaatatacagaagtctacattatatgaatgtatacagtggtatgtatggagattttcaaaatataaatggtagtaatatatgcatgggttcatatagaaataaatggatagatgatagaagatagagagatagatacttaatacacccttgtcaatatcccccaaagtactgtataaaaaataggaacagatcaaggtgtacttacaatattccttagtcataataatggttaaattgaactatagcagtaacaaatgtaaaacaattgtaataggagttatttggtgccagatttgttagtaaaataataaacaagtaagtatgaggtattggaaaaatctgtgaatttttattgtatttatttcttgcataatatttatcacagagttacttcattcttccaagaaaggataattatgtacacatgaccttatttacaagtggatggctaaaaatgacccagatgccttgtgtattatctaggcaatctgccaggaagttggccacagcagagaggatcagaaagttcccactcagtccagacatgtagagtaataaacattttcatcttgctgtactgttattgctacaaataataagctagaaaatttagatcttgatcaaagtgtttggatgtctatacgttattatacaggttgtatgttagcaagtcagccatagcaggcaaacaaccttatacggtttcaatcataacctaaatgacctgccatgttaaaagcaaaaccaaactaaatatagtgtgtcttccactaaggatgaagaaaacagattaggtaaatttaaagtgtataaacttgtaaattgtatatatggcactagaatgatgtaatattacccatgtgtgaaaaacctgtgaatatcattatactattcaaagaagccagccctcaagttagtttgataataaaaacaacaaatatgtacatatgtattgtaaaattacagcattcagaccctttgctttacagagcacttatctagtttaaaatcaatgcatatatttattaattcataaagcaggtatttaatgagcacttgcaacgtgtcagggactgtttcaaggtcttgtagacacataccgtactttccaagagaggcgctcagggttgattaaagtgttgaatatcaaatgttatttttaaagttcttttcatatttgaattatttgatatgggtggaatcctaacttacgggaggtgaaaaactgtaaaatcattcattcaacttagtctttttaaatatctcactctactcctctattaagaagtcctgtgttagtaaagtagatggctccttacgtgatgatatttaaggagttattgacatgttttcttgctcttagctgttttccagatgcttgtgttcctgcctgaaaggatattatgaaaaaatgtcctctaacatcacagcacacctttcagggcttaacacattaagctattaccagttttattttacaatcctaaaatattaatttatctaattactttactcaattgagaatacaaagctgaacaaagggacaattatagaatattccacatcccctaaaaagtgtggctctgagtagaagaatattgtcctgtagtaaagtagaatgtaggcaaccaaagtaaatttacaaaaactaatcgaagtatgcattcacccagggctaagcttgctactaaattcgttgtatataaattaataaaatagagaaaacagtatttgcctttgaggatattgaactctagccactcaaggtaacgttttactctcctgttacagcataacagtgctaaaaaatgtcgtatgcatatatacaattttaaaaaagaattttaaatgagtccataaatgacagaatggaaagtaaaggataactggtgttcttaagagcttccagaagttggtaaaggttgagaattttccgatgagatagtagacgtagatcataggcacatgacatcctatgagagtgagcagccagagtcatatgactgaaataggcagacaaagtaggaaagtgatgtatgtttggcctgaaatactgggttaagccatctatatttggtgcagtcaatgtttgacaaaaatagttgctcaaagcttaagcaacaaggttttttaagatatgtaaatcaattaaaaaccattgaaattgaaagagtaagttgatgtaaaagacttatagccagatttttcaaatgtattttgttcacatatgctttgtcttctgttttcctacaaaaaaaatcagaattttcaataaatatttattagaaaaatgtacagttgacacaaacatttagaatgactctagaggctataaaagcttactttcaagtgctaagaggcagagttaaaattatcataaaatatccctatgtctaatgctaacatgcaaacataaagttacaatgtattttgtaaactatatctgaatatatagaccaggaaatcagaaatatccttcttgatgttttctattctggaatggcataaaggtgctcccttttgtaacttgtattaaaatatttgtgttaataattgatatgttaacagtacaaaatgatgagaatatcatatgaatccctataccacctaggagatcaaagaagtcaaaagtgtcttcttcagtaattagtttaatttgttctcaatagggaattctaaattttatccttttaagtttatcaacataattcaagctgttgattgcatagtagattaatgatatgagtatgatatataaaattctattagcagctcagagggtgattttagaaaagtaaacatattggaactaaaggaaattgtttttgccactgtttgttttcatgaaattttaaaaaaaagagcctacataaatgtaacatgctgcaaaatatgactatagagtcagaggtcagttaaaaacaaatgaagagatttgatgtaaagtttatatttcatatgcgttttatttagtatccaaatgagattctcccacttaataaaatatcaacatatgaaaatagcaactctttcaatatactatttctgaagctatatatttagattgcttctttcatttatttttagtataattgtttttgaaactttaataaggcaaattagtagttcctagttctagataaatgtgagaatcatacagggagcctttaaaaagtactgatatctatgacccacactcaagagatttggaagtaattgattttataagtgttttggctactggtgtatgtgcaaatctgcccaagtgatccttgagtgcaatcagggttgagaacaattgagagaaatcaagagtcatcgattctgaaatatgagacagtactttcaagatcttcatgttggatttgattttgaagaactaaccaagtaaaatcatgattattaaaataattcccctaaataatactattatgcttatgctttgttattaaagatggaagaagcagtaactatatctcattagagaaaaaactagtgcattgtaagaaaaatgcatcattatgattttttaattttcaaatttacagattaaaaaaatcaatgagtagaatactaccaaaatgaatgacaacagaaatttcaaataattgcatggaacaaattattatggcccttagaagaatagatgcgagatatgacaacttgtgaagaagtttgtctaggtgtggtgtcaacttctaatcttctgtcctctgataagggtcaatcttccctggttgatgaaactccccaggttgggatttaatgacaattgagttcctttcagaggatctgtctttaggcagataagaggaattcagagaaagcctctccctgcgtttgctgtttttcaggtactttcacctcagaataatcagtataccaaagtggcatattgagatggcatattttgtttccttgagagatgatacctagatgatacataaaaacttgaaaatacacgtatttcagttatgcccaacaactagcaggatatgacacagtggcacaacgctaacttttaaagttagaataccagcattcagaacttggcttttgagttacaagcggcgtgaacttgagaaaaatcacttaatttctgcaagctcataaatttcggctccagttgagctttctaattctagagcccaaaccttactgattgtatttaaacatagctcctgttgtttttctttgaaccatctccatctgaaaaactggaaaaccattttcacttcaaaaaattttgttgacacacaataaaaaattgtactgaaagtagaaatcagtactaagaatatgttgcaagaagtctacctcaatttttattcagacattcttaaaatatttaatacacattgtaagagtctattagagctatgactctcaaactttaaagtgtattcaagtcacccaggaataaatgcagattctgatttgcaatatttcctctgtaacctgtaattctacagtgcgaacaagtttcccggtgatgcccatactgctggttcctgctactgctggttcttgcatcttatttgaatggcaagattaaaaaaaaaaaaaaagccaaaaaaggcccacagatttggctatgtaagtaagtaaactaagtagacgctttgaaggaaattcaggataaaactcaactagacgctggattaaatgccacacacacacacacacacacgcaccagcaagttaaaaccacagcagcaagcaagctatgagtggtaagaataaaatggtgttgtctgagattgaagccaatatccatgctgcattatatagacggagtcttggacttctactaaggtattggatctaaacctgaaagttctacattgaaacaggaaccctcaaaggaggttaaagtgatctcaatttggaagtactccacagagaatcatttgtacattttctttctaagaaaacatccccagttatgcctttaggactcccacagatgacatgcaatgaaagatgagctcctaaactacaagtaacaataattaatggagctaacctattatgagtcagcaaaagcaaaaatcagcaaatctagaggtgctaataccttagatattatataaaatatctgaagaactaaatgagagatgtaattttaaaaagcatggtagagactatcacaataagacagtaaaatccttttaaaaataaaaagataaaactcaactgctatgttaaacagtgtattagaaaaggctgaataaagaagtgaaatggggctaggcatggggctcacacctgtatcccagcactttgggagaccaaggtaggaggattgcttaagcccaggagttggagagcagcctaggcaacacagtgagaccccgtctctagaaaaacaattaaagataaaaaaaatagtactcaagtatggtggcatgtacctgtaatcccagcaactcaagaggttgaggtgggaggaatggttgagcctaggagatggaggctacagtgagccatgattactgtcgacagaaaacttcataaagtttgaatgcaagtcatacatgcatagaatagtgtctttaaagtgctaagagaaaataacccatcaatctagtattaattatccagcaaaacgatctttaaagtgtgatggttaaataaagataccttcatataaaaatataaattttaacaccaatatttcttcactaacaaaattcatgatagtgttcttcaggaagatggtctatcatattggaaagaaggacaccctaaaagaaaataacataaaaatatgcaaatctcaatctcactcatgattgtatataataacctaccatcaaaagaatttctacatcacctgaaaagaatcacatccagattataagatcctttaatatttaaaaaaattaaaaaacagaaatattagtatgtaaaagtaattaaatgttatatctgataacatacaaatcacatttataaattcagtggggggacaggtagcaaagacttgtcattttacaaattatttggatggctgcaatttgaaatgcaatcctcactgcctatggtatgtgtttacagagttcctgcatcttattctccttgtttggaccttagagtctgccaattcttgtactcctcctgccccagattgcttaccacatgttccatagattttgattttacttgccaggagtatatgctagagtcaaactgcttggattcaagtctagatttgagctttgaacttgaacaaattactctgcctttatctcagttaacagacctgtaaaatggatatcataattgagcctacaaaactgaagctgttttgaggattaagtgaggtagtacatgctaatgctcataacagggcctcataaaaggaatatgacaagtactcaatattattttctttagaccatcaagtaatttattgatgcctttaatacaaagaaattaagttagcaaaatctttataaaactatattgctatttattgttttgaaaaaaaattacagcatttgccaaatgtgaatagagtaggtctagacattggttttaccaacttgcagtcctttatctgtgtcttcattaataatttaaacgtggcacatatatacatatgtaacaaacctgcacgttgtgcacatgtaccctagtacttaaagtataataaaaataaaaataaataaatgtaatttttaaaaatgtagaaaaaaatgtgagagaaggggttcaagatgactgactagatgcagctatgacgtccctcttccacagaaaggaaccaaaatatcacataaatctacacaatcaaataggtcttccaaggatataacactgaaatttagcagagcagatgacaggaggcaccagggatgaaaagggaggaagcagagcttcctgcttggacaccaggaccattctctggacccaaagccaaggtagtaggtgagtgaaggaaccccaggacttcatattctagctgcagacttctgttctaactacagaagagttttgtgaccaccctagacttctagactgtctgaggaagctgctggtgaccatgcagagccactgcttgaactcacacggaccccgctgagcaactgcagcaaagcacagttctgggagcccatcccccaaggctctgcatcctgccctaagctgctgctgctgtatctgccaggctgaggagtgagcaggggtccaacactctcatgcacctcaaagacagcttctactcccatagttgtagaaccaaatgcattagaaccacataacccatgcctgcctatccctcccaagactgcctgcctggtcattcctgcagtgggggacccacagcatagcaaccattgcttcatctgcatgttttagtggtggcctaggagtaattcacccctccctatcacagccaaagcttaagtccaccaagccagagaacaagtctgtgggcctggccccagtccaggggcatggagatcagatttgtaatctaatctcaaaccaaggaggaccctccactgtccaaatacagaaaagatcatggtgtgggtccctgttgtggcatgggggctgagtgcccctccattcacgagaatggactgagaagggtgtggcctgatagtcatgctatctatcacagacagggattcttgcagcctggaacagctcagggatcaaaaggtggactgcttgggaactagcctaattattctggctactgccagtggagaccctctggatttggggtgtgaaacctaagtgtgtcccagtgccacctgatatgctgaaaactctgggtcagtgctcttctctgagtggactcttggtgcaagacagttgcctctgcccctccctggagggttgcccaagtggcctggctgttgtccctaaccccattgtaatcagcatttgcattcaccaggtcacaggcttgtctgacccagcccactcagctttgtcaccttcaggcaccttggtggaacattggacatggacctcagagagcaccagggccctgcccattaccagggacaccccagaaattctcttgattaacaaagggcaagtaaaaatttcactgaaaacaacacagctgcctctctcctacaagcaccacctactggtggggaagccagcctgcacataccattacaacttctgacaccattgtatagcactaagccactcttactcacaagtaccacctatgggcttgtagagtgaactgcacaacccaatataattcctgctgacagaagtgcagggaacaagaaaagcctcccaagaccttcacctccccatctctttagcagaaaatgagcctgcacacactcacagtacacaagtactaaaacctacaaataaccagcatttgagaaagccactatactaaggatatgtataaccaaggaattcatacagagacttggcccactaacagcacaaagaggcaaagccaaaggaccctacccaacatgtgcaacactcccaccctcggggggaaacaaatccctcccaaacaaaagaaaattcaaaagtaaaagtggcagcttctccagatgagaagaaaacaatataagaactctgacacttagaaaaatcagtgttgcgacacccccaaaggatcacattaggtctgtagcagtggatcctaaccaaagtacaattctaaaatgacaacgaattccaaatatgaattgtaaggaagctcaatgagatccaagaaaaccaacacaaagaaataagaaaaatttccacaaatgtggaaaaccaatacaaagaaataagaaaaaatgatttaggatatgaaagatgagatagctgttaaaaaaaagagagtgtctggaaatgaaaaattcactgagggaacttcaaattactttaattgaaagctctaataataaactgtaaaagacaaaagaggttttcagaactggaaggcaaatcttttgaattaacctagtcagataaaaattagaaaaaaatatatttaaaaaaaataaacatgaccttcaagaaatatgagattatgtaaagcaactaaacctatgaataataagaaataaaagtaaaaggtttggaaaagtatttgagggaaaattcaggataatttccctggtcttgccagagatgtagaaatccagatacagaaagcccagagagcatatggaagatactttataagatgaacatcaccaaggcatacggttatcagactatccaaagtgaacatgagaggaaaaattttaaaaacagagagaagcatcaaatcacctataatagatatcccatcagattaacagcagacgtctcaggagaaaccttttaagccagagatcgaggcctatgttcaggtttcttaaagacaaaaaatgccagcccagagttttatattttgccaaaatgagcttcataaatggaagagaaataaagtatttcccagacaagcaaatgctaagggaatttgtcactactagactggcactacaagaagagctcaaaggaattctaaacctagaaacaaaaagacaatactggtcatgataaagcacacataagtacaaagctcacatcctataaagcagttacacaaatgagactacaaagcaactaggtaacaacattatgataggtacaaaacctcacatatcaatattaaccttgaaaataaatggccaaggtgccccacttaaaacatatagactggcaaataggattaaaaacataagatccaatcatttgctgcctacaggagatctacctaacaagtaaggacacccacaaattcaaagtaaagggatggagaaagacataccatgcaagcaaaaaacaatgatgaccaggagtagctatacatatatcagatcaaacagacattaaatcaacaacagtaaaaaagaaaagacaaagagaatgatggttattaaataatgacaaagggttcaattcaacaagaagatatatctatcctagtatatatgtacccaacactggggcacacagtatttataaaacaagtactaaaggaaagggatatgtagccatacaatcatagtgggggattttaacaccccactgacagcactgggagagatcctcaaagcagaaaatcaacaaagggcctctggacttaaactggactgtaggctaagtggatttaatagacatttatagaatgttctacctatcagccgcagaatatacgtttttctcacctgtgcatggaagattctccaaaattgaccatatgcttagtcataaagcaagcctcaataaaatcaaaaaaataaaaataatatcaagtatctttaagatctcagaccatggtggaataaaattagacgtcagtgcacgaggagaacactcaaaactacacaaaaacatggaaactaagcagattgcttctgaatgactttttggtaaatgatgaaattaaataacaaatcaaaaacttgaaggaaaatagagatacaacatatcaaaacctctgggaaatggcaaaagcagagctaagaggaaggtttatagtgtaaaatgcctacatcaaaaaaaatacagagaactgaaattaacaacctaatatcgtaactcaaggaactagaaaaacaagaacaaatcaaacccgacactagcagaagaacagaaataacaaagatcagagcacaaataaatgagattgagacaaaaaacaagaaaaagatacaaaggattaacccttttctgatttgccccagaatacttgctggtggtgcttgcagctgcagtgtttgccccaagataactttgccatgaaatatctcaagtatattatttttgcatcactctaatatattgactttggaaacaagacatcattctatttatagtgttctgtttttagtggtggtatttccatttacaaacgatagtaagtcttgatggctaaaaagtcaaatcctagaaaacagcattcctttccgtgatgttaacatcattcttgaacagttgttgatcaaagattcatttgttgaatacaatttttccaaaatagacaattctgataattcagatgattctgatgttagttctgcttagaaataacaacaagaacagtttttatattttattttcacattaaaaatctgtaagatttgcttcaggctcaaagagtgtgtttatgtaaaatttaatgagcactggcagcaagctgtgcttttgggttaatgaaataaaaggttggctcttaggaaaccataagcaaaattgatagactgctagctcaattaaccaagaaaataagagagatttaaataagcacaatcacaaatgataaaagtgacattacacagaaatacaaaacatcatcagagactactactagtatgtctttgtgtgtaaactagaaaacctagaggaaacaggtaaatttctggaaacatacaacttcccaaggttgaaccatgaagaaatagaaatcctgaacaaaccaataataagtaatgaaattgagtcagtaataaaacatcttccaacaaaagaaaagccccagaccaaatggattcacagcccaatcttaccagactatctatctcaatagacacagaaaaagcattcaataaaattcaaaatctctttacaataaaaaccctcaacaaagtagacattgaaggaatagccttcaaagtaataaaagccatctatgatgaactcacagagaacatcatactgaattgagaaaagctgaaataatttcctctgagaaccggaagaagacaaggatgcccactgtcaccactcctattcaacatagtactggattcctagccagagaagttaggcaagagaaagtaagaaaaggcagccaaattggaaaagaggaagtccaactttctatgctcatcaattacatgaaaaatgacttcagtatcaatatacaaaaattagtaagatttccatacatcaataattttcaagctgagaaccaaatcaataacacaatctcattaacaatagacacacacacacacaccaaatacctaggaatatatttaacaaaggaagtcaaagatctctacaatgttcactgtttgagtgatgggcacctagaaccccaaacttcaccattatgggatatattcatgtaacaagcctgtgcctacaccccctgaatctataaaaataataataacagaaaactatatgcattatgttctcacaattgttagaaaccatgtgataacttccttaaaaacatgaaatgccgtatttacaaagtcaatttttagatactgcctaaagttggttatagattgtaccatatctgtattctcttatgttgatccagcaaaagtaggaggttttccttctgtcgttttccaaatgttggtcagaatctaatatatcatctggagagggtgttatgaatgcttatacaactacctcaatcttgctaaacatgagatagtaaagtaattgtttccataagttcaccaaaaactggtataatcaagaagcaatatatagtattattgttattccccagggtcaatggcttccttcatgttgtatgattccagagttttcttgtatcccatcaccaataagttttgtagaactgtcaacccaataacaaacagagggggagactccttttttaagagataatggtcttttaggaggaataggcattgcagtgagaatatgagtaccattgtaagctatgtgtgtattcagggaggtaaaataaaacaaaggtttttaaaggaaaaatgaggattacataattgttttgagataattctcaactgtctagggagttgctagacagacgtcctggcagatgtatattttgtgtaaggttataatgacctttgtgcaaggttgtggtttttgcagtctccgtgatagttatttttatcaagcatttgtgtataacaaccctcccttaatttcatggccttccctggctctgtttgtgaggatctttaacataagtgactctattttgattttgacaactttcacagaactttccatttttgtcagcagggttagtataggtatactaattattgctttaatttaaatttccttcatcaaaaagaagtttgagtatcttttccttttggaattgtttatctctatattttctgttaatataatttacacatttaaaatttatttatatttacaactttacaattatatggatcaatagggcttataacaaaaagaaagaaattcctatgcaccccagctcattttttaccatattcctcagaggcaattagtttctcttttttagctttttttttttcatctgttcatatctaaataaaattcatacactgcaatcttaattttagacattacatatattggtagattaatatatttagctaacttccatgctcctattcaatatttctgttgctacaccactgtaaatattgttcactgctgggaaataaaatgtacattgaaataaaaatgttttttcttctacagtgattttatcttaaaattaataatcttcattacgtctttcttagtgtgcttaattttctttaaaatataagagtaacttttctaatatatcttatactctatattttaataaattttttcatacagctaaatgtctcatatgatttgtatctttcttttctcctctgtacatttttcttctgtggttctcatcttgtctttggttttgtttctttcttaatgtctgctgcacagtttttgtcctgagacttccttttgcttattcttgaatttcttctgcctttttcttatgtgaaatcccatttagtaattattttctatcaatgcgctcctattttatggactacatctcctcaaagcttcttgagctcttcagaaaaatggtatagaatataagtatttaaactctttgcatatccgtgtctgtgtatatatagaactgtatatttaatatagagtaaaaaaaatccctttaacttcatattaaggtaattttttccttaaattttattttactatgtatattaataatacatgtcaaataaaactatattgacagatgtacaatgaaatataactctttctaaagttttaacacaagagaacttactctaatttttctacatctgtttatcatactttatattatggtcaatattttgtatatattctatactttcagatttgattttctgcttgacccaaatgggctgtatttttcttcctttaaatcaggaatatttttaatatccaaaatgtatctttaaactttttagtttcttcttttcctcacattttttaaaaaatttttatttctcttgattttcctagtttaaattttaaaataccttatttacctttaggaaatgacaacagttaaaaaaaaaaacattttaatgcattgtgctaacatcctatttcatgtttattttactacttcttatttttacaacgggaaaatgttttaaatcatttgtcattgaaagaatttgacaattctcaatgagtcttgaaattctactgcataggttttttattttgtgtcataccacatttattgaaggatttatttttaaatatgaagtttttttactagctaaaataaatagagaaaaattattttgtatttttacaaagtgttttgggtgcaacgtgtagcttaagagatagcaaaatgcatcatataatgagttgagcactttccaacttcaagaatgtattggttataaaattcttgtcgccaaagtatctagtattcatatttacctatgaattttttcatagagtattcttaatatttttaaattggtccattctcatgtattagcaaatttacccccaaatgacatacacactgccatatttttatttgaaactaaatgactaccatattatttgattgctccttttaaattatacaatattgccatcctatgaaaaattattttagaataaagtactaattttaactgacttctctgtagctttagtagtgttggtctttctctcattttataacctctgtccttgaatattgaagcctgcatcctagtttccatgacaaagttttcttgattttattctatccttccttgacattctttcttagtgtagttttctctgtagtttacctgcactcattaattaaatgtgaatgtttctgagagttccaaaaacagcctctcattctctttgctgctggagaatatcacttagttctattatttccaatactctctgtatgataatgtctcccaaaccatatccctagcatctctctccttaactcttgtttccaataatcataagactattgggcatctctacattatttcctcagactcaggcatctcaacccaaactcttcaaaactgaaagattttcacagcttccaaccttcttaatccatgactcttgtactctctatattaggtaactcacaccaatagctaccttatcaactaagcagaaattttaaaatgatgcctcctcttctttttaaaaaatttttcatgttcaattttatgcatgtcctttagattctacctttctttgaaaactcttctttatctttagttgataatcttgttattttgtcttgattatactaacagctttctaattgtttcccacttctaattccttttacctccagttcattctctgcactactgccagaatactctctaaaatgcaaagatgtttaaaaagaaatgaaaagaaaaataattacaatgtgtggagtgatgtaaattgctcttttaattaaaaaaataaattttaaaatgcaaatcttatttgtcatgctcttccttgaaatcagtagggaaaataatcctcttttaacttcccatcctcaactcaaaaattgaaaagatgttggcaaagcacgctggcatcatatgctcaaaccacactatatagcattttcctcctttacctaaattttcctttgcccacctctcccccagtgaaacataactctttctacagaatttatcttggatattacctcttctgcctgagcagatatattttacacagctttctgatagaatgaaatgcagctaatatttataaaaataacgagattcatttgggcacatctaattttgtatagtcatgaatgtcggcctttggaggccttatggtcaagacatgtctcagacattaaccccccatgcagttcactgtgctctgtatgataattttatgtttacttgacttttttcctttcttaactatgtcctcctgagaggaaaggaaccacattttttttttctgcaaagcacaatgccagtcacaaagtggcactacttactgatttaataaatgaatctcatcttgattacttttcttgttataaaggtgtttaactagtggagaaaattgtattaagtctttctggaagtacaatgtcctccttttagtaaataaatataatgtttatttatttaattgagtgattagtggtgcaacaattatacataggaaaaactataaaaacattcattaaattggtagtattaaaaagcaaattgtgcaaacccagactgggagatgttctgcagcatatctggtcagtacaccctaagactgtcaaggtcataaaaatcaaggaaagacagtaactgtcacagactcggggtgataacaactaaagcattgtggtattctggattcagtactagaaaagaaactggaaaaccggtgaaatgcaaataaagtttaaaatttagataatggtaatgcgataatatccattttttagttttgacaaatgtaatatgataatgtacaatgttaacaatatgggaaactaggtgaggggtatataagaactctaatctttgcatattttttgtatatctaaaattattcaaatctaaagtttatttataaaaatgcatttatgacttaacaaaaattttattgttaacacagcataatatacaggttttttaaaccatatgcacccagagacacttgtaatgaaagtgtacttcatatctttaaaatgcacatcttaggttggtcacatggcttatgcatgtaatcccagcacgttgggaggctgaggcagaaagattgcttgaggccaggagttcaagaccagcctggacaacacagcaagactccatttctacaaaataaaaattaaaaattggttggatgtggtggcatgcccctgtagtcctagcctctcaggaggctgaagagggaggatcattaagcccgggaattcaaggctgcagctacaattatgccactgtattccagcctgggcaatcagagtgagaccttgtcttgaaaaaaatgcatatctttttcaaaaatttgagggaaagttagaataattgtttaaaaatgcacatttccttttaatatatgctacttgctataatattggttttgatttgagatgatgcgaatgcttttatgatcacactactgtgttaattctctattttatattaaaattttaaaaaattatatctaaaatgattttgccaaaaatgttgcatagaactctgaccttgaaatcaatagaaatttaaactcacttttgtctgtctggatattatggaccattttcaatttttatatttaaaaacccctcacagcaaaatatgttctagcaattgatctttttatctattacaaaaatgaaacattccatttccttatatcagggaacacatttgaggggtgggcaagcatacgtttgtttcttcctttcattaatgttttgctggagggcaaatgtcagagtagccactttcatattttggcccctcttgctgaaactcctgtagggaaattctgcagatgggtttctttgatggttcttttcatttttatctcacgctgtgactttgacagtcagactggcagtaggatacagaaataaaagaagaaggcttaaagaaatgttatagcttcatgctgtgaatttagaagatgacaggtttttttggcttgctttctctggcccatgactaaaagaactgtcactaggttacagtgctaagaagaagtaatgagaacatattttcatgcagatacctagaggactttgatgcacatggcctgcccaagtcaatcggaaactctgaggctaaaaattgctgtggcaggatccaaaaccacatggctgagaaggatgcttggcaatcgtgtttgtacagttttacacagttgacatgtaataagcatttattaataataatgacatgtaaatttgcctttcatgctgttgcagcaagaatctatcatctgtcagtttgtctgtctccactgtataatatatataaagaatatattccttaaagtaatgatgaatcagtatgctgaatgtgaccttattatttttttgtagaaaggtgtctccaaggctttgttaagcagcaagggattacatttccactaatgagaatccttagggctatgcaatagtaatatttctaattgagaaactcaaaaattgcatgtgaaaaaactttaaaacatgaattctatatgtttataacaaatcttaagaaatatgtaaaagtaaaatcacttaaaaataaggaagaatcaacctgtgatggttgtaagatggtcaaatttattatcattttaagtacaaacttatttttagatatgatatgcctaatttttaaagagtatgtattataatgtattataatacatataatacattatatgcattatatataatatatataaaaaacagattttgtcaggatactagaaactctctctagaaaggttttaagctctattaatttaacttactgaattctatgaatttaactcccatccttgagaaaagtccagaagtgttacattctgacttacagttcattcttgtaggaagtcaacatttccttcctaagttatgatgagctttggtgtagatgcaataaagtaattattctttctgtttgtgttgagaagatgtaatataacaaaaaaatcctgttctagttaaaaaattgatcttcagactaaattaaaccacagaaacctgccatgaatacagtgattatttgagaggaattttcactaccacctcctaagtcaggccatctctattgggagacaattctctattgataatgtttctatatatcatctaagtttcctttgtttcgggcttttttgaagacgtttgtatagctaacagccttttacaaaagagatagtgtcttcctgtagagtaaaggacatgtttgcttacagtacagtaaaataaaatcaatgtcttactctgcagcaacgtttaggctaccttacctttttaacctagctttgacctgttacaaaagattctaattctgcaagctcagggttccgcccctgttcctcagtccactaagtatgcacctgtctctgtggtaattgggacttgggaaaacaacgtgggtgctgatactctggttgcctttataactgtgagtaatgaagttatttgtctctgatccagggatctcatgtcttctcccaatgttcatgagactacaatagcctaatatgtaagcttgaaagcagtataaatctcagttccttcacagttcttggtgctcacctcccttttccttatttgtagaaagtgttttctttttagcctctcctcctctaatttctaatctctttaattcttcataatatgccactgtctggttattcattctaatgttcacttctgagccaaatctcatgactaccaattttttattggttaaagtttaaactttaattaattcactaattcattcatttatcagattttttaaagtatttactatttactacttaggcacttgagataaatggtgaagaagttagtcatggaatactacatagaagtctccagtattggctttctgtacattccttgtctcatcttatactattgtcttcaaagaacctatgccccagcaaacttgattgagcctcgaaataggccctgttattctccaagcctgtacttttatctattcctaaaatactctgcttctggatctccatcaattaaaaatgagtctatgcattatagcttcattttaagtatgatttctttgtagtttttcctttttaactccacttagaagtgatcttttgtctcctttcatatgatactcacatatattgtaatcattgaatgcattccttaattctgtaccaaacaatggcaatttgaggaaatataaaatgttttgcataatttttgtgttttacagtgccttatacatagtaggtaatcaataaaactagaataagacagtaaatacagatatgagaagcacccaaagccaagccaagtcaaccaaattcaattgatagagtttctttcttccttcagagctggccatttgagcatcagcacacaccatcaacataggatctgatggtctgagtttaacactatctgggtcttagtggccccatttttaataactaggtaaagaatataattatattttgtgccttactgtgagatgcttcagagttcctgacaaataataaataacctgaaacataaatctagactatgaaattattattacttgaaaatttaatgtgaaaaataaaataattatttcattttcactttaatacaataaatctaactttgtggcatcatgaaaatttctataatttatactggtaataatatatgattatattattttaaatcagtattaagtatgtatcgtagtaattatatagtacttttatataatcatatttagcgtttttattaataaatggaatttactgagtgcttattatgtgtcatgcattctgcttaatggtttacatacagtaacttcaagaggtagatattattatttccatgtgtgatgtgggaagagaaattaaagtcaagaaatgttacgtaacatgcctggggacataagtaacctttaaaattaatggccataatgactgagaaacgggatgccaaaaatcaggctttagttggagattatactcctgtacaaagtttgtgtttcactaagtgcaatgtctgacaagaagagcagaggaaagttatactaatacattgtttagggttgtttctaccaaggattttagaatcagggaataaaaataataatagagtttatattaacaggtggagataaaattcacttctgcaacagctctgttcctttagcattttataataaaaattatttatgtgaaaaagttgatgacagtaaaaccattgcaagtataaactaatattattattaataaataatatatattaaatattttatattagtaattttagatacttgaaaagaaaggaaaatattacagaactaacactgaaatgcatagaggagcaaaattaaattattgtcattatctctggtttctactaagggaagattctgtgtgttcaataatatgcagaattagactttccatcttgctttgaccgaggattcagcatttacttaatacttattatcctttacttcagtttggctgcacaactaaagtattcttaaagccaacaatgagaatggtcttaatgattacttcttttcattgcccatttttgtccttctacagtaagagggcaataagaaggaaagccaactcaatgtctttttcttctcatgtgagacaaagacagggaattctaggattgataattaaagccatccctgagcagcattttcgttaattactcttatcctatgaattctcttctattaaaacattatctgccttgtatttcatcatgctatcatgatgctttcctggtggctttagagttgtactagttaaaagggtcattatcatctaataatcattctgagaacctaaataggcacaggtaataaagggtcacctctgttatacctagtaaaaatgttaaactagtgaactccagcatacaaaaagaaagactgagtttaattaatatattgtatatattgtgtacctataactctgtcagttagacagctggtttaaatatctcttatgtacactgttcttcatggaaagtcaatgcttataacttctgataagatcaacatcaatatatagctttggtatatcacaatttttttcaaagtgcttgagaagcattaaataactgattagaaatgtaattctggtccatcaaattatgattcgataatagtttaaacaaaaaaaatccattccttccattttacccactataatgaaattactccttgtcatcattcaaccttgtattttcaaaacggttattaatataaaagcaaagtgatgcctttggaaacgttttctgaacacaacatgaatcactttctaaaaaattacaatatgcatattttaaataagtaatctacataggatccaactttcaagcataattggtatttgatgaatgtttgttgaatacaaatctcagtaatagagctccagggactaaaaaaacatagttacctaacatttttttttccttaaaacttctgggaataattgatatctaataaaatgttatttatttacacctaaatgtaattgattgtgccatgtggaatttcattagattgtatggacccttcctactatgagagcaacttttatatgaagcaatactgcatgtgatcaaaattaaacttccactcctggccccatcagaaattccaatatggtcaattacagtgaacactgatacttcctaaaaatatggcaaacttcggctgagtgcagtgggtcgctcctataatcccagcactttgggaggctgaggcaggaggatcacctgatgtcaggagttcgaaaccagcctgcccaacatggcgaaatcccatctctactgaaaatacaaaattagcccagtgtggtggtgcctgcctgtaatcccagctactcaggaggctgaggcaggagaatcgctcaaatccagtagatggaggttgcagcgagccgagatcatgccattgcaccccagcctgggcaacaagagctaaacactgtctcaaaaaaaaaaaaaaaatatcagtctttgatggaaactattagggcactgatacatccaaatttgcatatattgggaagatatgtctcgtctttttctttaaacaataattaatgaatttttattttcattttcttcccctatgtatatttctactatgtaccctttaaaatttgtttattttcttttaaattggcaaataataattatatatacttgtgaggtacaaagcgatgttttggtatatttccacattatgaaatgattaaaccaagttcattaacatatccatcacctcacataattaacatatttttatgattcaaacatttcaaatctctcttggaaatgttataatatacattacattattagtaactgtagtcactgtgctgtgcaagagatctcaaaaatgtattccctgtgtctgaaactttgtaccctttgtccagcattttccccttcctccacctttaaaaacattttattgcttgtgtaataatgctataacatttatagtacaacattgactactattatgcatctgtttactcagattttgtgaacatttaactcactctatttttttgaaaaggctggttacaccttcaaaaacaaccctcatttgtgccctctagactgtctgttcaagacacagtgatgaaattatatcagatgaaagatgccagagccatctcaattagtttaattgactaaaatatgcatactttattcacattttagaccacattcatctgaatatataaattagatggttatgtaaagaaaccaacctagctgtttgtatgacttaggtaaaataaagattatattgtatcacagttttctatacattttctagggaattccaacactttgaagcttctatattatgtggggtttttttgcaatagctaagagataattagaagatcaatctttttcttatcttaaaaatagaatatgtaaacattaagtaattattattttaaaatgtcaagaaaggcaatattgaggaaagaaaagaaaatttcaacatttaatgttctattttacaatactaaatgaggttctcttttctgttagagtgaaagaacctcagaccaaaacccctcaaaaaatggattctgttcttttgccgtagctgtacagaatcttccagaagtcattcagtttctctgagacccatcctaatcattgaaaaagagtacagttatgctcttcccaaatacctgaatgtttgtcagtacacttcatgacaaataatgaatattgctaaatacaaaaatatggtaattctgtgtattagtttgttgcagttgcataacagataatcaccaatttagcaacttgaaatacaaatttattaacccacagtctttttaccccagatccaggttgacttgactgacatcattgttctgagttttataaggctgaaacttaagtgtcatctgtcttgggttttactaggaagctctggggagaatctgcttccaagctcatttgagttgttggtagaattacttccctgtggttgtaggaatgaggtcctgtgaacctgctggctgtcatccagggaccaattttagctcctcgaggactcccaggcccttgcatgtgggttcctacatctcagagccagcaacaccacacatatccttttcaaacttggagtttctcaactgcccctgcagccacctctcccttcaagaggtaaatgaagccacctcttctactccatctctcttctgcttctggttagaaacagctctctgctcataagggctcctgtgaatagactaggccaaccaagatggataatccagaataatctccctatattaaggtctgtaaccttaattatatctgcaaagtcccttttgccatataaggtaatgttttcacaggttccaacctcataccataatacaaatgtgaagttattttatcagctctgtaaatggatatagaagaatgagcttggaaaattgaaataatactggtcagagtcaagggagtgttcatgttaagactggagtgactaaatagtcttttaaatcagatgtgggtttgatccagaatctgatcagaatgcaggaaggaaagggacctgtgtggtaaatggccatacctgaagcagatttcatattgaagaataattattaaaattttagatacaaataaatatacttaacaaaatttctccaaaaatgtaatttaataaaatcaatgttaggcagattaatatgaatgtgctatatcttatctgtaataatttaccttgattaacagagctattgatctcaatttaaaacaaccctgattagattggtcagtagattgtttagtgcagaatatcagagatacaatgaaaaaaaattaataaaatttattcattagcagataaaagttatagctgaaactacatttatgcagttatgacacaggcaaatttgcttccatatagtttttagttactctggcattaacataaatgctgtatgcttgatattttaagttatatgatggagaaaaggtcatctgcactttttacaatttaagaacattgcttgttttactcttaacctctttttaatgtcagtttaatattttcttctatttgaggaagggactaaatagggggccatttcaatataggtattccagtgtttgaaaatgtatccctattctcaaacacatttgaaatatacttttttggttaaaggtgaagaatttatattaaatgaaaaaattagtaattgaatttaagaagaaaaccaactatgtggttattatttagcacagcaacttttagagttaccaccattcttgcttaagaagtacagtttcatattgaagaagagtagagcttatttttgaggtataaaaagtcatatatctgttgtaggggatctgaatgcctcagtatctgtgaagtaacctttatagagaaaggattaagtgttagtgttttcatgaagtgcttcaatcttagtaagtttaactttattttgtcacaaacatgtcaccatgaagattaagaagtttgttttattgttatcctgagcatttgtctttatgaaataacttatattcttattaaagtttccaaatggtgggaaatagtacattctattgcttccagatattatctgttttaagcactattatataatgaatttccagaggttatttttgtggttattgttttcttttggtataatttgctagaagagtcaatatatacctgaaataatatttctacttagcagtacacataaatattcaattttgtatttcaacccctaaatttcctaagtccatgtttaatataccttctgtcgagagagagagacagagacagagacacagacagagagtgattataatatattgattggctcatgtaattacggaggctgagaaatgtaaaatctgcagtcagcaagctggagacccaggacagcctatagtgtaaattccagtgtgaaagccagaaggctcaagacccgagaggagctgatatttcagtctgagcccaaagatgagaaaagaccagtgtcccagctcaatcagtaaggcaggaggagttccttcttactcagactttttgttggttcagatcttcaattgattagatcaccgcacctacattagggaggggtatctttactcagtctactgattcaaatgtttatctcatcgagaaacacgttcacaaacacacccagattaatatttggtcaaatgtctaggtattccatggctcagtcaagttgacacaaaaaattaatcatcacaaatctaccccttgtcaacttggcatccatatgcatctccctaaaccatacttctccaaaaaaagacaataacaaggtcatgtttcctcctaacatgttacagttatcctgtgtacaaccaaaaacacactaatatgttagaagtggagataaagtcctggaatgatgttaactcttctccttgatgtcatgtaacttacacaatataaggtaaagttaacacatcttactttacatgataagggagtaggggagggaagaaaatgaaaatatttgctttatccatctgtctgtaaacacacacacacagacacacacacaaatttattacaaaataaggtgaaaacactcatgacaactagtcctcattttctctgtaactggccacgtggccatagctggtatttacaactaccttcttctactacctattctgtactccctttgtctttagcaggcacctcaagtggtcatggttctttacaagtgtcagtcgagaaaaatgatgagacaagtcttaatcattttaggagacttatttgccaaagttaaggatgggcaccagggagacaggtctatgccttttttctggagatgattttgaaggctccaaatttaaacgggaaagggtgggatattgagaagtacacaattttcatgtaagaagggggtagggaaaaatagtcatttatgtctttgtctggctcagtgaatctgcattttttacataagatgacataaaccaatggagtagaggaaaatgcagggaatctgcattttacataagataacacagacaaattggaccaggggaacaatcagatatgcatttgtgtatggtgggctggaggtgactgcacctctaaagataagctatcagtttgcattgccatggtgaaattttaacagctcactaggaatttctttgtgggcaaaatatgggggaggcgtgtagctttttatgttgtagccatcttatttaggaattaaaagggggaggcaggtttgtgtgacccagttcccagcttgacttttccctttggctaaatgagtttggggtcccaaaatttagtttcctttcacacatggtaggatgatacacaccttcattcatgaactgcctggaccattattagccctgcctggattaggttaatgttgttttctaatgaccttaatcacagggcatggtaatactaagagacaccctaaagaatctcctgtattctagatatacatttccttaccttcattgtggagtcgtgtttcagtttcctcttggtagtcaggatcaatccctccagccagcacagtaactcacttattttttgagccagaggcatgagaagcacaaagtggccaggtggtagtcttaacttccagttcaatggaatcatcattacgtatgttggtggaagtattcctgtactttggaattaagaccgctaggccagaagaacataaggttgcaggaaccagaaacaaatattttcctgctgggtcactgggaaaatagtgagtggtgctacttctattttcatccctttattcctaggcctgtgaattatggctgctggagaagccataccttatattggatgctgattcagaatatatacagcctctggaaaaccttccccaaccctgtaagatattgctaccttactggcactgtaactgggtcttcaatatgccctgccactattctgtcaagccagctgcctctggataatggggaacatgttaagaccagtgaatttcctgagcatagacccattgccatacctcctttgctgagtgagtttttggtcagaagcaatgctgtgtagaacactatgatggtggatgaggcattctgtaaatccacagaagttttggcagaagtattgcatgtaaggaatgcaaatatgtatctacggtgtgttattcctgtgagaacaaaattcttcctcttctatgatagaagtgattcaatgtaatcaacctgacaccaggtaactagctgatcaccctgaggaatggtgccatattggggactccagtgtttgtctcaactgctggaatattgggaactcaaaggtgacgatagccaagtatgctttggtgaatagaagtccatgttgctgaatccatgtataacctccatcctgccatcgtggtcgctttgttcttgagctcattgggtaatgacaaggtggccgggaaaaaagtctgactggtatctacagaacaggtcatcctatccactggattattaaaatcctcctctgtgaaggtcattctttggtgtgcattcacctaggacacaaatatcttcacttttttttctgtttttagatggaatctcgctctgtcacccagtgcagtgcagcagagtgatctcgggtcactacaatctccgcctcccgggtttaagcgattctcctgcctcagcctcccgagtagctgggattacaggtgccccccaccatgcctggctaattttttttttatttttagtagagacagggtttcatcatgttggccaggctggtttcgaactcctgacctcaagtgatctgcctgtctcagcctcccaaagtgctaggattacaggcatgagcccccacatccggcctatctttacatatttttacccattcagagaggtctatccacatgcatcttccttagatttccctgtcaccaatttccctgttatcttccttccaagttcctaatcatctagccatcattggctgtagcccatgcattgtgctacagaattgcaagtctggtcatttctcctttccagcaaagtgaataatcaggttcactgcccagagttctgctcactgagaggattccccttcaccagtgtttcagggctgtttcagaaaggagccctagttctgtagctgtctacttttgagtggtgcctgcatacaggaccatctataaatcaggtaccaggcttttcttttgtttcaaccaaatgtagggactccctgcccatgaggccataggtgcagacaggagacagaaggccatggagcaggagtggggatcatgggtatttgagccgtttctttatggaacttactttgcattcagggcctgcttgggctggataacgtatttactacttccatttgatgatggagtgttgtttgcatgcccaactttatggcttcataggttagttaacaccaagtttattatgagcatctcaaattgcatggtaagttggtggcctgtgtttaagtgttcggtctctactaagtcccaacattaggccaaaagctgtttctcaaaggggactaattatttttagatgatgcaatggttttgctctaaaatccaaagggcctgtactacagacctgtagggacctgttctacccttcacctgtaggaacttgccaaaggctctaaacagcttccactaccactaccgctgacactttaagcaccattggatctgcttaattgtatggctcatagtggaagagcagcttgcacagcaatctggatctgttgtagagtcttctcttattcttggctccactcaaaattagtgtttttctggtcacttggtaaatgggtgagagtaacacaaatgaggagtatgttgtcttcaaaatccaaagaagcccacaaggcgctgtgcctttttttctttttcctggcggcaggagaggtcagatgcaacaacttacccttcaccttagaagggatatcttgatatgctctaaaccactggcagaaaaaaaaaggcccctgaatttttgtcatatttatttatcactctgacacagaaatgtcttaccaataagtctaaagtggttgctacttcttgctcactaggtccaatcagcatagtgtcatcaatgtaatggaccaatgttgtatgttgtggaaaggaattaaatccttgtgaactaaattattacatgaggctggagagatgatgtatctctgcagtaggacagtgaaggtatattgctagctttgccagctgaaagcacattgcttctggtggcccttattgatagggatttagacaaaggcatttgacaaatcaatagctgcatatcaggtacaagatgaaaccacatctgcagcagctgcaattggagtcactacctgaataagcatatgataatctactgtcattctctaggatctgtctctctcctgcacaggtcaaatagtcaagttggttgcagatgtggttggaatcaccattcctccatctttcaagttctcaatgatggcactgactgctgcagtccctctgggaatgtagtattgcttctggtttacaattttcctaggtagagacaattctagtaccttccatttgccctttcccaatgtaatagatctcactcaacagataagggaactactgggattctgccaccagctgagtatatctgttgcaattatgtattcctgaactggggaaataaccaaaggatgggatcagggatccagtggaccaactatgggacaaaactgagcaagaactctatttgctgatatccataagcccctactctaactggtagaccatagccatgtggtctcctggaattagtatcaattcaaagccagtatccagtagtccctggaagatcggattattcatttttcccaatgcactcttaccctggtaaaaagatagagatgcctttcaggaagggtgagagaaagattaacagtgtaaatttttggcagcgttttgaggtccttcctcaagggtacccagcctcccctcatttaaggtgttctgggtctatttactggctcaagtctgggaattgattgagagagcatgactctctgtttatatgattcaggcttgacttctgttcacttgacttggaacttagtgttagatatctattttacttttagaaacactatcaactagccaatgtcatagtccttctcgactcagattatcttgatggctgcttcagttctgctgtgcattatcataacccttcccactttgcctttggtggttgagtgctgtgtatcagcccctgctgccctggaactgattacttccattgcattcaggtttcctaattcagtagccacagtttccactgtaaggtctggcttacagataagtgaaatcactcccctcacatatttacttttcaaattatttatgaaaggtatgtcttctggactctcccattgtgggttctactgaaatgacattaagacttaaatgacaaattcactctaatattccaattcctctaagtttttaaatcatcttctgtccattaaaccaaggcaggtctggcatttccaactcactcatgatgggtcatcttttgatccatatttcaaccaactaagcaaacaaaccattagcaaacaaaccttttccagctccccaaacgacaaaatttattgcaaaatctctgcttattgagctcatatcaacatattcagcttgacttaactttatattcaaaattatattatactcttactattcattcccacacatgtttccaggatttctgtctttatacatttagaaaactcagtaggtcttttggaatataggacacctccttaggagtcacaatttgtaccttgtctagttataggtctagaagtaaagagggatagtggtgatgggtcctgaggaggctcagcataaacttgcaaggcagctatcccataggagaccattacagtctccacaggcagtgtaaggctaattccctgagatggggatggagaggcagctttcatgccagggaggcatctgccactggcaaagaagactcatcagaatttaagaactcagtgaccttggctgcatcaggccattcccacatggccccaatttacagaattctatttcttcccagtcagtgccctcactgtaacagtagacaccctgaaaaagctgggagtatacttgtattatcattaagcctgttgaaggaagatattctgcatttgatttttaacaatttcaattctgcagctactggaaataaaagtcttcttgtgggtacacacagatgccttcaggttatttttgtggtgcataaaccaggaattccaattcttgagcttttctttctccacttcttccagtgacaataggaggtaactagccaatctcattatatttgttcatatatatttgacatacatgtccaaaaatatcctatacactttcactcagatccttgcttcttataagtagtggaataggagtatcacatatagatattttgcatatttgtattgccagattgtgctagggactatctatcactgctctctttgctgttggaatagtgttattagcatctttaaatctaatcctatcatattatttgcctccacgtaaccacagatggctaatttggtcatatattcaggcattagtaaatggttaaaataatagtatctcttacatatctcattttatttcttacgtgttttatgtagactgttcaatttctgaaagtttaaacctctcatgttgcttatttttctctcctctgctactttttagtgttattatgtcctttaaaattgcaaaaataagtagaggcttggtttaaatattatttaaaattgtgaattggaaatactgagtacttcagtattactcagatataactgagtaattcaattatatcttcaaataactggtgttatttgaagctatattatattcacatggcatatgtggttcccagtgggcaaatgatattttgggagacagtctttttttcatgattaagtcttactttactttttctctcttcgcaaccaattaattgtcagcttttattggctctgctttcatgatgtcacttacttatctttatttctaccaccagcatcctatttgagggtcttattaactctttctggaacttttatttaatggactctttctctttaatcatttctgccactgatccattctgaggccaatttaatactgtaagaacagaattcttatcaataatctttatttctcaccactgccaactaagttgaatatgaaatacacagcttaatatgtaagaccctccacatcagggcctcatgctaccatttcaaacatttttgttactagtcttctacatatagaggtagagaaaaactggtcactttattgtgagttaaaatgtgtttctgtttttgcatttgcattcctttgcttgtgctgtcatccctgactggacttctttactcctttgctgtaatcttttccttggagataccacctatactccaagattacctcaaatgtcttctcactctccaacaaaatgcaacctttctattctcttaaattccacttcagggacttgtaacatatataatattttcaacatcagattatatatatttttcataaattattataaacagtataccttctgcaaagtataatgacttacacttgcaaagtatataataagcatttttaaaatttacttaattgatatcactatttggtgagctgcaggtggcattaagatcatggggcagtggaaatcagagcaaatatatctacagtgtctggttctaagagtgaaaaatgtctgagcctggtaaagagcagaaaagagtcagggtataatgagcagagacaagtctggactaaagtgggacagactagaagtgattgttatagcctaggatcattatcactctgactctactggttaagttttctgcagaaggaaataaagattttgctagcgtgagtgagcaccactgtgtaggaaaaattatctagaaagtagaagaggtaaggagcttctccatatgggaagtagaagtaaataaattcttattggaagttgaaatggtattatattttggtaattaatgatttctttgaaagtctagtgttaagtattcaataaaaaattgcattgtgtcttgtccctacaaatcaagtttgcaatgcagtctgacaaatacagatgcttttggtttcaattttgaaaagaagtgcatgactagatttctgtgtacctatgaagatgtgataaattatttcatattttcatatgtcatttggaataggcttagaatatctaatggaccactatgttttttaatattgaatttgggtgattgttttattgtagaagcaattactctcccaaaggaagttttaatttaatggagcaaacattcggtaatcttgttattatgtgcaaatatgtaagtgctgctatgaaggacactagatattgttctcagttccaaatacttacacactttaaacaattagtttgatattaaaatacctttatagtttttaaaaagaccttacaataattaacaaaacatttatgctttcatcctttgtagtcaggaaagaaaagctgaaagtatgtacttgtttttaaaaaaaaaaaaaaataacaaacgtgtgtataatggcttctatgatgttggggggtggggagaccctgcctgtgatcttatgtatcacgagtaggtgatttattaagttaggttggaaagtcaaattaaaatagaaattaaaacagttttctctcatggttgacaaaaatccatatttattcatatttggcagatattttagcgtttttgaagaatctttggaagaatgttaaatacagtgcctgggctaccatacacagttgtttagtttgtggactgcataactccaaaggccccacattcctcaggatgggccagataattctgcagtgacaaatgcaccctaaatcagggcagattatcataacaatgttttgtttctttctcatgctgtataagtactgctgatcagctactgctctgctacatgtcaccttcatgccatacttctaggctaaagaagtgtctcctattatcaatttctgttcagggaaacagggaaagggaaacagtgaaacataatcagactcctaaagcttttaaccagaaataatacaggaacttcagcttatatttcattggacaaaggaattcaaatgaccacaattcaccaaggcatggacatataatcttcctacaagatacaccgtggaatattggcagacattaatgtgatctaccagaggcaccattcatattcaataagacacaaatgacatcattcatgtatgcaaaatgctgttgtgccaggaagcatcttttctgtttatttatattaaagcaatacagtatattatctgtttgaattaaaaagaaagaaaaattcagacagatggaaaatatgggtttgataagaaatcaaaagcatgtattcccttctttaatacttctgaggatcatttatcttttcatctaccaccaacctaaaagtaaatcacaaagggaaacagatgcctcagacggtgcccagctttcctctatctcagaaattctacatagtcccagcttcctcttaatgaagtctcaatgatttctgtttcaacttagaccctgaatttctatgttttcagcctccataaatatttattttaggtttttttactctactgtatgtttaggtgtggatattcatgttaacttttattttaaaataatcccaatctaagttaattagagaattgacttagacatgtcattaattttgaagttcaaaaccctgagtattaataacaaagctaactagctgataactctctgtgctttaagatataaggtgtcataaaagattatgtaggttctttttaatactatcaaactctaaagaatagtgttcattaagacactttgcatgaggaacagcctaatttatccaagtcatatttttatatagcgtatttaaaataaacagtattctttagtattaattataatggataataggttttcaaaactaatatttggaatccaaatattcttaaaataaatagatggctcaccatttttattattagtaccatagcatccattttaatactctgaagttttaattatttcagtattacacaaattaagattttagactttacctttctctttgattccataactaataaagatttaaactattaaagatttcaatataatttcattttgtatgtatttagtaaagagaattcacttaagaaatttttcttaagaaagtaaagattattaatttcatccttttcacatgatggcatgaattttaaaataattctgtttatagttttgctgacataatggaaaatatcaattgttataaagttattataaaataattaatttttttactgtgactgaaaatgttatttgtaaattctgacacctgctttttcattctcaacaacgattctaactctacagttatttattctataacactttgatatggtttggctctgtgttcccacccaaatctcatgttgaattgtaattcccaattttggaggtggggcctggtgggaggtgattagatcgtgggggtggtttctagtgctggaggaccatccccctagtgctgtctcatgatagagttctcaggagatctggttgttcaaaattgtgtagcaccttccccttgcacgtgtccatgttctctttttctctctctgtgtttctctgtgtgtttctctctctctctttctttctttttctctctctttctctctgtctctctctctctctctctgtgtgtctctctctgtctctgtctctctctttctctctcctgccggccatgtgaagatgtgcttgcttctcctttgccttctactatgattgtaagtttcctgaggcctccccagaaacagaagcctgtacagccccaaagaatggtcagctcattaagacccttttcgttatacccagtttcaggtagttctctatagcagtgggagaatgggctgatatggaaaattggtaccaggagtgggttattgctataaagatacctgaaaatatggaagcaacttcggaagtaagtaatgggcaggggttggaacagcttggagggatcagaaaagacaggaagatgaggaaaagtttggaactagagagttatttatagcagtgtgataatggactaatatacactcttttttctagtacttgtagagtggcatcttacattggtgtaggattattatacttcgcaacacttgtgtgtcacattggagactgtcttatgctctcagaatgttcaatgtagtcaatttttccttcagcgttgaaagaggttgttgtttcttcatttgagatccaggtgaagttgtttgcctgtgtttaatggccattaaaccactagtttagtgtttagttggattaaatgcacacatttttaagcaatcaaatcacattcaatgtagcatcacatgtgctgaggctagatgtgtgaagggcatggtagtttagctaagacacaagatacaatagcaggttctccactttgatttcctgttcaatctggaatacacattcattcagtgcaatggatagtagaattaccttcaatgcctaattatttaggcattctttttgctctcttcttatccttctcccttcctgataatcttcctctccctatctagttaaactattattagtatcttgtatgtatgatgtggttccattgtaaacttctttagaggcttattaaagcctctcttctacaggctcattttctgatatgtcttcccatttcatttgcagatgaaaagaattattgtcaaactaatataaattcatagatacatatttgcacagtagtgcttcgtaaaatgcagccatttatgtattgattcttgtcttatttttcctttttctcattttacctcaccttagttttttcatttgaataaatgaattgcttttcccactactaaaagtaaaatttgtaaagattttaactttatatgtttttactttaagtagatttcatatgcaatgcaaaatttggatgtgaacaaggaggctataaaaaagccagagtaataagtgggagttgaacaatgagcatgcatggacacacggaggggaacatcacacagtggtgcttgtcagggggtttgggaaaagggagggagcacattaggacaaatacctaatgcatgtggggcttacaacctagatgacggattgatagatgcagcaaaccaccatggcacatgtatgcctatgtaacaaacctgcacatttagcacatgtatcccagaacttaaagaaaaaaaaaaagccaaaatagaaggaaacaatcactgctctaagaataagtgaaggagttctatatggaagggaattgaggaggggaacttaaattttaggttttatggttgaaggcaatgagcaagttaaaattgttactattagtgcaactttatttgtacacaaaattgaatcaagaaatccatgttttatgactgaaagaccactgctatgaagctgcttttaatacctggggcgtaatctgcaggaatgagccatgatgaatgtgaaagactggataaagttggcaagtttaaggcttgtgctgaaaagagattaagaaatatggagccaggcgtggtggctcacatctgtaatcccagcactttgggaggccgaggtggacagaccacctgaggtcaggagctcgagaccagcatggctactgtggcaaaacctcatctctactaaaaatataaaaattacccaggtgtcatggtgcatgtctctagtcccagctactcaggaggctgaggcaggagaattgcctgagcccaggaggctgagattgcagtgagctgagatcttaccgctgcccttccacctgggcgacagagcgagccgatgtctcaaaaaagaaaaagaaaagaaaaaaaaagaaatataggaccaggtctgagaggagacagagaaataaattccaaggagttatacatatgcactcttcatattgatacactttttcttttttgagaatacaggtgttcctcaagttaaaatggggttgcatcctggtaaacctattgtatgttgaggatattgtaagccaaaagtgtatttttgcatattgaatgtgtatcactatgaagtcaaaacatgtatcaccataaattcaaaaaatgtaacttgaaccactataaataatggactgaaaaggagtgagaaactcaccattaagtgtaggaactaaccaggaaaaaattgtcttagagaaaacgagacaattagaacaaagatggttagtatcagctacagatttatgagagatggacggcattgatttcccatggagttgagacaaaccatgttaaatcagtgtttttcaaatgtttaagtgaatgaatgaatgaaaaacattaagtataaacatttattccaaatgcatagaaaggaattaactactatctaatgaatgaaaagtgtgagaagaagataaagcttaaacttttttgaatcatggaataagaaaataggaaaatttatgtgtaggagagtaataatatcatttggtagaatctaggggggaggaagagggacaggaattgaatcacctatatttataggaagcaagaaataatgaacatagaattaataggaatggagaagaagacaaacatgcaacaggtattataaagatagaaccaatatgttcaaagatagaaccatcttagaagtgacatgatttctgggtaagtttggaaccacagctagccccaaaattcacctgtaagttattgggagaatgatagtacaattaccagaattatagcaaactagaggatgaacagatttaggatgcagttagtggggaggaagaaaatgattagttcaattagagacataataagcttaaatacctgtcaattatgattcccagaagataatttgaaaaaaagcctatgtcatttgtcaaaggcagaaaacaggaatcaccaagagccaatccggagtagaatgagtttagggataacaaaaaaccttggtaaactataggttaaaattatggagtaattactgaagaagaacaataaggctatactatcaagtaaatcaaagcagcaatatcaagaaggaagtgccttcaactttgctcaattcaatactgaggtagagtattgagaaaggcaattggtatctgatttactggtcacctttaagaatatggttttaatgaaatgatgaggggaagccaggttgtaatgggccaaaaaagtggtgggtgctgtcttgaacatggcatatatagactgatgttttgaaagtttacagtgaggcattggtttaaaagagtgtatagtgacctaaatgggattaggatcaagagatgtgaaatatgtagaaataataactattatatcttacctattttctgtctcctctggatatgtaactattttatatcttatgttgagttttgcacagtttctgacatacaaagaagtttcttaacatatttgttgaattaatgcagaaatgagtgagaaggccagctgggaagctatttacttttctatccagaatgctaaaactctcatcccttgcaactatttcaggaatagatagttcaagcaaaactatctaattgcactgtgattcttactcattctaaaatctgttattggtacttgtacatagaggaaatatgaaatgctgaaacacaactttaagcaaatgaaaactagtcatacagttagacacaatgccaaatagtttttttgggggggactgaattagattcctttttaagtgtcgcttctggcccatgaatatgtatctgtaggtttgtgtacatctgctttgatcataacattccaaaagtgtcatatcctaaagaaaaagaattgctctaaaacttagagatgtacttactgttgtattctatcagtatctcaactggcttgctttgaataatagcatcatcaatttacttttctgttgctcaaatgaccggttacaaagcacaaccaaactgttgtagttttaggaaatcaacagtatttacatttttattgagcaaacagaatgctattcattgctttgaccaggggttactgatgatctgaaaagtgattaatggtcagcaacaacaaatttatttcaggagcttatagatttccatgggatgtgattttatgctttagttgacttgccatgttttgtcatttttttattacctcccatgccatatactgtgtaaatatattaaactttttgagatatcttagatgttttgactggatctcggcttacacttggacaagttagataacctaccaacagtaataaatgtaaatgtgaaatgtcataaagtgcttttgaaatgtattaaagcttaaatgtcaagtggcatgctagcatattttagaaatatgatttacattaaatgttttaaaatattattttaagacatttaaacaaatacgagctaaagaactagtggaaatgtctgttcatacaaaacatttcccaatgccagaccaatgtggaaaaaatatttaaaattttatgaagtatatatgtattaagtacatcatggtcagtaaataaagagaccactggacttgtaaccagatcatttagattctagtcctaaaatatgccaggatagcagcagagtgggaacattttttgaaaactatactaattactatgtgtcaggaaacagaacattaactacactcttaattctacaagtattttcaacaagtttcctgttgtacttacctttatgaaataatcagtctgcttctcttttaggtaagtggaatctgtaatgtatacaagatgtgaaaataaaagtactttgatttaatgtatagatttataattattaactatcctgccaaagtaacaaatgacacatttaagtgcaaacatgtaagaggtgtatatagttataaagtacatgagatgttttgacacagggatgcagtgtaaaataagcccatcatggagaatggggtatccatttactcaagcatttatcctttgagttacaaacattccagttacattatttattttaaaatattcaattaagttgttattaactacagtcaccctattgtactttcaaacattatgtcttattcattctttctattttttttacccattaaccatcaccttctaccttcccccccagtcccccactacccttcccagcctctgataactatctttctaccctgtatgttcatgagttcaatttttttttttaatttttagatcccacagataagtgagaacatgtgatgtttgtcttttgtctttatgtacctggcttatttcacttaacataatgatctccagttttatccatgttattgtgaaccattagatctcattcttttttatggctgaatagtacttcattgtgtatatgtactacattttctttatccattcatctggtgatggacatttaggttgcttccaaatcttaactatggtgagcagtgctgcaacaaacataggagtgcaggtatctctttaatatactgatttcctttcttttgggtatattcttagcattaggattgctggatcatgtggtagctcaatttttagatttttgaggaccctctaaactgttctccatagtgcttgcactaatttacattcccacacagtatgcaagggttcccttttctccacatccttgccaacatttgttattgcttgtcttttagatataagccattttaactgaggtgagatgatatctcatagtagtttttatttgcatttctgtaatgatcagtggtattgagcaccagtgtctatacctgtttgccatgtgtatgtcctctaagaaatgtctattcaaatattttgcccatgtgttgatcagattattatagtttttttcccatagagttgtttaagctctttatatattctgggtatcaattccttgtcagataggtagtttgcaaatattttctcccattcagtgggttgtctattcactttgttgattgtatctttgccgtgaagagccttttcaacttgatgtgatttcatttgtccatttttgctttggttgcctgtacgtgtggggtattgctcaagatatttttgcccagaccaatatcctggagagtttaccccaaagttttacttgtagtggtttcatagtttgaggtcttagatgtaagtatttaatttgctttgttttaactttggcatatggtgagaaataggggtctagtttcattattttgcatgtggatattcagtattcccagcaccatttgttgaaggactgtcttttccccagtgtatgttcttagcatctttgtcaaaaatgagttaactgtaggtgtgtggatttgtttctgggttctctattattttccattggtctatgtttccattttcatgccagtaccatgctgttttggttactatagctctgtagcataacttgaagtcaggtaatgtgattcctccagatttgttctttatgcttaggatagttttagattttctgggtcttttgagattccacagaaattttaggcttactttttctatatctgaagggtcattggtagtttgataggaattgtgttagatctgtggattgttttgtgtagtatggacattttaacaatattgattcttctaaccccatgaacatggaaatatttttccattttttgttgtaatcttcattttccttcatcagtgttttatagttttcattatagatctcccttcatttctttggttaatgcctatgtatttaattttttgtgtggctattgtaaatgtaattacttttcaaaaatttctttttcacattattcactgttggcagataagaatgctattgatttttgtctgttgaatttgtatcctgcaactttactgaatttatcacttctaatagttttcttgtgtttcttttctaacagtttttatattaggtttttccaaatacaagatcatatcatcagcaaacaaggacaatttaatttctttattttcactttagatgccctttataaccttctcttttctgattgctctagataggccttccagtactatgctgaataataggggtgacagtaggcatccttgccatgttcaagatcttagaggagaggatttcactttctgcccattcagtatgatactagctttggtctgtcatataggcttttattatgaagaggtgcgttctttcaatactcagttttttgaggatttttatcatgaagtcatgttgaattttatcaatttttttcagaatcaattgaaatgattatgatttttatttttcattctgctgatatgatgtgtcatgttgatttatttgcatatattgaaccacctttgcattgcagggataatcccacttggtcatgatgaatgatctttctaatatattgttgaattcagtttgctagtgtttagttgaggattttttcatcaatatttgtcagagatattggcctgtagttttcatttcttgatgtgtcttagtctggttttggtagtgggataatactgggctcatagaatgagtttggaattattccctccttctctgctcttcagaagagtttgagtaggattgatattagtttccttaagactggtagggttcagcagtggactcgttgggtcccaggcttttctttactgggaggcttatttaatagctttgatttttgttactttttattggtttattgaggttttgtatttcttcctggttcgatcttggtaggttgcgtgtatctaggaatttgttcatttcttccaggtttttcaatttattggcatatagttgctcatagtagccactaattatcgtttgaatttttgcagtattagttgtaatgtctcctctttcatttctgatttcatttatttggatcttctctttctttcttagtgtggccaaaggtttgtcaattttgtttaacttttcaaaaaatgagctttctgtttcattgatcttttgtatttttttttcatttcaatttcatttatttcagctgtgatctttattgcttcttctactagtttgggtttggtttgctcttgcttttctagttcttcaagatgcatcatcagattgtttattcggagttttccctctcttttgatgtaggcacttgtagctataaattttcctctgagtactgcttttgctttatcccataggtattttatgtttccattatcatttgataaaagaatttttcagttttcttattaatttcttcattgacccactgttcattctggagcatatagtttaattttcatgtatttgtgtagtttccaaaattcctcttgctattaatttttagttatattacattgtggtcagagaagatgcttgatatgatttcagttttttgaaggtttaaagacttgttttgtgacctaacatatggcctatccttgagaatgatccatctgctgaggaaaagaatctgtattctgaagctcttggatgacatgttctgtaaatatctattatgtgcatttgatctatagggcagattaagtctgatgtttccttgttgattttctgtccagaagatctgtccagtgctgaaagtgaagtgttgaagtctacagttattattatattggggcctatctctgtctttagctctaataatgtttcctttatatatatgcatgctccagtgtttggttcatatatgtttacaattatgatatctttttgctgattcaacccctttatatatctgtgtgctccagtgtttggttcatatatatttacaattatgatatctttttgcttaatcgacccctttatcatcatatagggactctgtctcttcttatagtttttgacttgaaatctatttttttctgagataagtatagctactgttgctcctttttggtttacattggcatggaatatctcttaccatctctttattatcagtctatgtgtgcctttaaaagtgaagtgtgtttcttgtagacaacagatcagtgggtcttgttttttcatccatttagccagtctgcatcttttgtttggagagtttggtccatttacattcaatgttattattgataagtaaggacttactcctgccattttgtgacttggttttctgattgttttgtcatcttctcttctttgtttctttccttcctgtcttccacaagtgaagatgatttttctggtgatatgacttagtttcctgctttttgtttttatgtttttgtgtatgaagttaccattaggcttgcaaatactatctcataacccactattgtaaccttataacaatttaacactatttgcataaacaaacaaacacaaagaaaactaataaaaattctatgccttaacttttatcacactgctttttaattttttgttgtttctatttatatcttacggtattcactatgtcctgaaaagttgtaatagttattgtttttgattagtttatcatttagtctttctgcatagataagagtagtttacacaccaccattgcagtgttataacattctttgtttttctgtgtacttaatattaccagtgagttttgtaccttcaggtgactattcattgctcattgatgtccttttctttctgattgcagtgctccctttatcatttcttgtaggacaggtctaatgttgattaaatccgtcagcttttgtttgtcaaggtctttatttctcctttatgtttgaaggatattttcaccagatatactattctatgattaaagttttttccttcagcactcttcatatgtcatgccactccctcctgtcctctatgctttccacaaagaagtctgctgccagacatattggagctccattgtatgttattcgtttcttttctcttgctgcttttaggaaactttctttatctttgatctttgagagtttgatcattaaatgccttgaggtagtctttgggttaaatctgctttgtcttctatgaccttcttgtatttggatattgatatctttctctaaagtttgaaagttctctgttattattcctttgaataaactttctacccctatctcttttttaccttctctttaaggccaataactctttgaattgctcttttctagatactgtagaatctagaggctattttctagattctgtagatggtcttcatggtttgttattcttttctttttcttttttgtcttctctaactgtgtattttcaaataacctgtctccaagctcactaattctttcatctgcttgatccattctgctattaaaggactcaaacacattcttcagtataccaattacatttttcagctccagaatttctgcttgattttttaattatttcaacctctttattaaatttttctgatagaattctgaattccttctctgtgttatgtggtatttttttgagtttcctcaacacagctattttgaattctctgtctgaaaagtcatatatctctatttctctcaggtgccttatttaattcatttgatgaggtcatggtttcctggttgatgctaatgctagtagctgttctttggtgtctggacactgaatggttaggtatttattgtggtcttcactgtttgggcttatttgtagtcagtctttttgggaaggctttccagatatttgaaaagacttgggtgttgtgatctaactagtacctgctttagtggggacctcaggcccagtaatgctgtggttcttacagacttttagaggtactgccttgatgatcttggacaaggtccaggagaattctctggattgccaggcagagactcttattcttttttactttctgccaaacctacagagtctctctctctctctctctctctctctctctctctctctctcctgaaccacttaaagctggaggtggggtgttacaattgcttctatggccaccaccattgtaactgcactgggtcagacttgaagccagcacagcactaggtctcacacaaggcgtgctgtaaccactccttggctactgcatgtgttcactcaagaccctggagctttataatcagcaggtggcaaagtcagccaggtctgtttccttgccttaaggttggcaaggtcccccaaattctgggttggtccagatgtactgtcttggaatcagggacaagagccaaaaacctaagaagtctacttggtgttctataagtgcatctaagctggcacttaaatcacgaaatgcagctcttcccactcttccctccccttttcaaaggcagaggagcgttcgtttgtagccaccagcagttcaggccacaaggagtaccaccagactaccaccaatgttcccttaaggccaaggtctcttgcttgtcatgaattcctcctgacctggtactcgtccttcagggcattgggcactcctctggcccagggcatgtccagaaataccatccaattatcaagtcctggaatatggagccccaggaaatcacttggtgctataccctgccatggtcatgctggtacctaaggtacaaggcaaagacccctttacttttctttctgctttccaaggcagatggagtttgccctgtagccaccaccacttgttatgtgctcagtctcacctgaaaccaccaggtttcagaggatcactgctggttattcagggtccaagagctcttcagttagcaggtgatgaatgctgccaagactgggtcttttccttcaaggtagcaggtttccctctgacctagagtgtgtctagaaatgtcatctgggagctagggcctggaatgggagactcacaactctgactgatgccctatcctgctatggctgagctggaatcctagatacaagataaagtcctctttacacttccctctcctctccttaagcagaaggaaggggtctcttttggaactgtgatttgtgcagcctggggttaggggaggcttgatgccagccctcccttggctgtcctagctagcgtctcagtatattaggagccccgccccccaaccccaccaggcaactgtctctggacctatttcagcactaggactcacctaagagttgtagtccgtatggcttagactacctttcaagtttacttggagacacagagtgatgtagccctctgtgatgaggtttgcaggtactcaagtttagaccactgggatcttcgatttccctctggctggtgttggtttaaatgatctttttgtgggtgggcaccaggtgcgtttggtctggttttcccttctgccctaacaagatagcactgagtacattgtctcagaattgctatgtcctttctcccccagtgtccagatatgctctcccaaccatattgctgctgcacagggtggagaagggtggctttggccattcagaagggttttttcatctcttcagtgcctctttcagcaatatgaatttaaaaccaggcactatgagtggtcacctgatttttggttcttatgaaggtgttttttctctgtagatagttgttatcttggtgttctcattgaggggaatgatcactggaattttctatttcacatctttctctgccctcctccctttccttgtttgttgacgttccctagcatgcaaagtaagtcatgcatgaacggtgcacaataattcttgttttgctttgatgtgttagttcttaaggatatcaaatagcagaagtgtatatatatatgtgtgtgtgtgtatatatgtgtgtgtgtgtatatatatgtataaaacttttaaccaggaaaatttaaatttaataaatttgaagttatctaaaatagcttatttataattattagaggatttggccagttgattttcgcactgagttcagcagtagacacacaatggttgatgaccttttttaaaaaagcaaatgggaaaactagatttatagcatggatatcaattctatttaaggcaagatgaagctttttctcttgtgtgtcaccttcttttcgatggctccactgcacagtgggtactccagggactgtcactgtgcttttttgaccttgacctccaaacattatgattcatctgggagccgacacttggcacagctgagccaattagatcccatcttctttaatttaaacttggaatggagaagtataactgccaaaggttgttgcagatgaatcattctggtggccataccccagagaaaagatgaacaaacttggtgcttgcccttccagaagctttttattatgtcccattggtttttcaaaaaagtatgcactacatttatttttctcattctgtcagtttggcttctatttcctataactaaaatgatattaactatcatttctagtttgttctcagaaaacaataattttaaaaatttctgagaaaaataattgcttcctgctgacattccatcagaatgttgacttttatccacaaatttattattataatattatatataattatcatattataataaatatgtttgtttcataatatattattatactaatacacttgcttatttaaagggcaacagtattgaaaaatttaagaaatgcacggaatttttagttttacaatgacagtctttacagattggttccttgcaattgactcttcagaaactataaattttttattgttaacatatcatagtttttcaactggaacacaatcagtattttgtctttaaggaggattaatgaaggtgacagaactgcatcctactcttgtgggaaaatatcaagaaatcagtctagtttcaatcagtcctgatgagtttgtgcagactaaagtgactccaggaagcctcttcaaagaaattgaatacctttaagacagatgatgttttcttcattgatattttaaaaaagtcttcacacatagtttcataagagaaagtagtgtagaactagttcagtatgttttaaataagaaaactggaattatgtgagtggtaaacataaggccacagcctatgttttactgaaaagtaggtggttgcctggaactctaaaaccaagaatagataaagacaaaaatttgtaataaaaatgtttaaacctggccaatttcttctttgttttttatggaagaagaaaacagagattttaaatctactttttttttcttctcttgggttctactttgttttcaagattatttgaaaatgctttttatttttaaatggtgtacatctcttttaattgtttagcttaattttatttaataacactgtgcaattgtaattcataagggctttcaaatatatatctctaattttcatgtgccctaagtagtgaatattttatgcccattttgtgatgagaaggtacaatcgagtagagtcaatgtactttcccaaatatcatcactctccctgactcaggtctaaagtaaaaattaagtacaattccataaccctgaaaaaatgttaattatcactagatgtgaaataaatacaaattaaaatgatgaggtacaactataaattccacaatattagataatgtgatagattggacaaaaatgagatttcattaaattatgctattgtacatctacattttctggcacaactatattttatgacttagtgtcataactttaactctcagctatacattttgaaagtaaaggaacatctcataaaagttattcacattctaaactaatttatgtaaaaagaaatagtttattctaggtagatttttctttgtcaatatctcatgttttctttaattaaattaaacataatggcctcactttataatattaaagatgttagtcattattggcagtcttaattttgtgtgtgtggtgtgtgggtgtgcacactcatagatgttcgtgttttcctggccgtaacttcaggtaagatcttgtcatgtcagcattgtaaatttattcagactccagaccttcctttttcattaaattaaccaatcgatgtctaaggcaatcagtggattctgcagaagctgatatgccttttacagcagttcagcaacaagatttgctcacttccttagttctgtgttacactttaaatttcattagctgatcttccaaaataataatggcttcattgtttcactgaacattttaaaatcatcattgaaagttcgattggatttacatagttttatagatagaattataaaatcatatacctgaaatgtttgtataacattaattttggagttgtacctttgccatgtatttttaaaaccactctaatagctttaaaacaatttcttgagaataagagaattattcttatgagaggttatcaagttctattttaaagcaatgacaactaatacaaggttagaagtaaaagattttccttgagtcttacattctgcatcctggaagcaactttccaatcaacagttttcatggttcatggtttcatcttctaagggattcttcctttccctagatgctccctagccatatatgaaagtcaaatttaaaatatgccatcctctacaaaatcagtgtgcaaaaatcacaagcattcttatacaccaataacagacaaatagagaggcaaatcatcagtgaactcccattcacaattgcttcacagagaatgaaatacctggcaatccaacttacaagggacatgaaggacctcttcaaggagaactacaaactactgctcaatgaaataaaagaggatacaaacaaatggaagaacattccatgctcatgggtaggaagaatcaatatcgtgaacatggccatactgcccaaagtaagttatagattcaatgccatccccatcaagctaccaatgactttcttcacagaactggaaaaaactactttaaagttcatatggaaccaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctgtaactacaagctgatttgccacattaccaatttaccaaatgtttcaacactgtataatatgggttgccatttttccagctctaataattattgtcttgcctggcctagaagaccatatcacaccttaaaaaaattgttatagcaacaccatacttttataaccaatttctgtaataagtcttgcattaactaagttatgttgtcataagaaatgacccgaaatctccgtggtggcttacaacaaccaaattttatttctcgttcacattatatgctagctgtggggtttagtcctgtggctctttttaattctgtacatacagatttaaggatcagttcttttctgaaatgtgtttttctgaggcaaaagaaaaatagaaaaattagaataatgtgatggctcttgatacttctacttaggaatgccatatataagccgggcacggtggctcacgcctgtattcccagcacattgggaggctgaggtcacttgacatcaggagttcaagaccaacctggtcaataaggtgaaaccccatctctactaaaaatacaaaaattagctgggcatggtggcaggcacctgtagtcccagctacttaggaggctgaggcaggagaattgcttgagcccaggggggcagaggttgcagtgagccaagattgtaacactgcactccaacctgtgtgactgactgagcgagacttcgtctcaaaacgtcaaaaaaaaaaaaaaagaaaagagaaagaaagaaaaagaaagaaagggaagaaagaaaaagagagagagaaagaaagaaaggaaagaaagaaagagaaagaaagaaggaaagaaagaaagaaagaaagaaagaaagaaagaaagaaagaaagaaagaaagaaagaggaaagaaagaaagaaaaatgccatatacaatttctgtcctcattacattggcaagacacagaatcaagcctaatgttaatcaatgagtacagagggggaggtgcagtcctcttagtttgggcaggaagtgattaggagtaattatataatcttttacactctcccaaaatataagaggaatgcaaattaaaacaagaatgagacaccatttgacacatatctgattggcaaaaatccagtatgttgatcatgccaaaatcagaactctcattctctgctgttgaaactataaattgacataatccctttagaaaaaaattagtaatgtttagtaaagctgtggagtttatgatccagaagtttcttatttttccaggaaaatattcccacatgtattcctgatggcatgtgcaaggcagctcatcacagcattatttttaattgcaaatagtgttcagcagctaaatggatcagcaaattttagaaattatggcatttacttatgatgggatgctaaacatcagctgtaacaaataaactgcatctacatgtatcagcatggataactcaagaattaatgtaaaaaataaatttaaaaaatatatttaaagtagacattaaattttaaaacacacagaagcatactatatattatttatttacgtatttctatattgcaaaagatataataacaaggacaagaaagaaacaaatcaaactagggagaagaagtagcaaaacaaagaagaggaaatggaataagaagaaaggcttcaactgtatctttaagattttatttgctttagaaagaaataaatacagcaaaccattatcatggagaaatgttttcatttattacatctggtgtgtgtcacatatatcatatgtttgaaatatttcttaaataaagaataagttatataagtaatggtaaatttgtactataaatttaatctacattatgcaaataaaaacagctccattttatgttaagtaaaaaaatcatttagaggaaaaatatgtacagagttatagtattgctgaaagaattaaacatgaaattatgtatttccaagtggatatacatatgtttataaaagcatataaaaaaatctagaagaacataggctaaatcattaacagtggctactgaagatgagcagtttgggattagggaaagaggcaggtgacatttcctttagttatattgtctgaatttaaaaattgctattattatattttataattttatattatctttacgataaaaattgaaagagttgatcattgaaagctcagcaatggtgatagttatctgccaccatgacattattacatttcattttgctgagatgatgctggaaactttacaaggtgtccataaaatctggaaatgtaaatataacatcatcaagtacaatttctgtctttaaaaaataaataatattatctacattttcaggcttcattgaaactttatgatatgagatgtgccaacaataatgagtaaggataatcaatatcaagaaaggtgttctttaaatacttattttaaattgtttgagaaatagcccttggaaacatgagcattcttgaagaatgtagaatcatgcagttcctagaaagttagttcagctgagggttttctgaaataaaattatttttgcttatagagaacaaggagcagtaaaattaaaaacaagcctactgtatttttttgtcattttctccaaacaaaattttaatactttaaaaatgtttggagtattttcatgccattatttaggctataaatgggtaaagtgcagtgcaacagggttctacttttatctctttagaaagatttatgtaacctcagaaatgtcctctatctcttctcacacttttcaccacaaggtcctttaattgcagcatttattttctctccactttggagattatacattattaggtttttattcaagggaagcttagaaacatacttggtctacttttcttcatttcaaattgtaggtcattatgtgactatgacttagttcagaaactgtatcttctaccaaataaaccatttctacttgtataacaaaaataaaaatgaatatatatagatatatttaaatgcattatgattggccacaatttttacgtgctattccatgagctcagaatcccatgctacagaatcccatgtagatctcccttctagttggtaacagtgtattggagatggatgaggatctgagtccccctgaatggaaataacagaatctcacataagctgactcagcactatctataagccatggatacttatagatagtggatacagtaggcagggtcagtagaaacgtccatgagagtttgggtaatccaaatatccatagggtgtgagaacatactacactttgaaaggaacagtatacagcaaccaccctttacttgtagtgatgctatcatgtccatcttttcactgttaccacttcaaaattcattggcctgacttccaattgtcagcatatttaactaccaacatatttatgttttgcatgaagactttatcttgtggctggattccagtttgtggacaattagtgtcccttaggaacagccctcaatgaatgacctatgagaagctggtgtaaaagcaccccaacttctttaccccttaagtgggataattctgaggtgcatgccactcttactgtcataatttccccagctggattaaactgcagttactcatgttggtagctggcatgaaaacatcccctttatgtgctgccttagtatctggaggaacccaaattaaaatagcattattgccttcatttttatgattttattatttatgttttaattgacaaatataaattatatatatttatgatatgcaatgttttgatatatgtatagattgtggaatgactgaataagctaattaatatatccattatctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacttaactgcttagaataatttgtaaaggatttgactgcagtccaaactgagacaaataaacccttcagtgaaacggcaccatattttttattttcatgggtacatagtaggtatatatatttttggggtgcatgagatattttgatacaggcatataatgcctaataattacatcagggtaaatgattatccatcacctcatgtatttatcatttattttgttacaaatgttccaattatactcttttagttatttttaaatatacaataaattattattgaccataatgaccctgttgtgctatcaaatactagatcttattcattctagctaacaatatttttctacccattaaccatcaccccttccctctcccccagtaccttcccagcctctggtaatgatcattctactctctatttttgtgagttcaatggtcttaatttctagcttctacaaatgtgtgagaatatgccaaatttgactatctgtgtctggcttatctcatttaacataatgtcctgcagttccatctatgttgttgcaagtgacagaatctcattttctttcacggctgactagtattccactgtgtatatgtaccacattttctttatctattcatctgttaccattaacagatgaacacttaggtggcttccaaattgtggagtttgcacgtagtgctgagataaatatgggagtgcagatatgtcttagatatactgatttcccttctttggggtatatatctagaagttggattgctggatcatatggctgttccattttttagttttttgaggcacttccaaacagttctccatagtcactgtactaatttacattcctgcaagagcatatgaagattcccttttctctccaccctgactagtatttgttattgcctgtcttttggataaaagttattttaactggggtgagatgatatcttattgtatttttgatttgcatttctgtgataatcaatgatgttgaacaccattttatataactatttgccactctatgggtttttttgttttttattttgttttgtttttgactgagtcttgctatgttgcccaggctggagtgcagtggcatgatctcagctcactgaaacttctgcctcccaggttcaagccactctggtgcctcagcctcctgagtagcagggattacaggcacagtcatgacacagggctaattttttgtttagtagagatggggttttgccatgttggccaggctggtctcgaactcctggcctcaagtgatccacttgcctcggcctgcaaagtgctaggattacaggtgcctgaccgtcttcttttgagaaacatctacttagatattttgcccatttttaaactgggttatcagattttctcctgtagagttgtttgagctccttatatattctggttattaatcctttatcaatgggtggtttgcgtatattttcttctattctgtgggttgtctcttcactttgttgattgtttcctttactgtgcagaagctttttaacttgatgtgatttcatttgcccatttttgtttcagttgtctgtacttatggggtattactcaagaaattttgcccaggccaatgtcttggagtttccccagtgttttcttttagtagcttcatagtttcagatcttagatttacgtttttaatcaatctttatttgatttttgtatatggcaagagatagggatgtagtttcattcttctgtatatggatatccagttttcccagcatcaattattaaataaaagacaaaataaaagactgacctttccccaatgtgggttcttggcacctttgttgaaaatgagttcactgtagcagtacgaatttatttctgggttctctattctgttccactggtcttcgtgtctgtttttatgccgacactatgctgttttggttacaatagttctgtagtataacctggagtcaggtaatgtgattcctccagttttattctttttgctcaggatagctctcgctattctaggtcttttgtgctttcatatacattttaggcttactttttctacttctgtgaagaatgtcattggtattttgatagggattgcattaaatctgtagattgctatgggtactataaacattttaacaatatttattcttccaacctatgaacatggaatatcttttcattttctgtgacctcttgagtttttttgcatcaacattttacaattttaattgtagagatttttcatttgtttggttaagtctttttaaggtactttattttatttgtagctattgtaaatgggattaatttccttgatttctttttcagattgtttgctactgacatataagaatactgcgatttttgtatgtgactatgtattctgcaactttactgagtttatcagttctaatagtgtttttttggtgagtccttaagtttttcccaatataagattataatatctgcaaacaaggataacttgattttttttttctgatttggttgtcctttatatctttctcttatctgattgctctaggtaggacttgcagtattatgttcagtaacaatggtgacagtgggcatccttgtcttgttccagatcttagaggagaggccttcagtatttttcccatacccacagtatgactttagctatagatctgtcatatacggcttttattatatttaggtatgtttcttctaaccccagttgtttgagagtttctatcacgaagggatattgaattttatccaatgctttttcagcatcatttgaaatgatcacgttttttgtctttcattctgttgatatgatatatcacattggttgatttcaaaatattggaccatccttgcatcctgggataaatcccacttgatgattttgcttatttattcaaaaaaacaacttttcatttttgttgatcttttgtgttttattgtttcaattttatttcttctctgatccttattatttcctttcttctaattttgagtttggtttgctcttgcttttctagttctttagtttgtagagttaggctgtttatttgaagtttttctactttttttgatgcaggtgcttattgctatcaatctctatcttagtagtgagttcaccatattccataggttgaaatatgttttgttttcattttcattttttttcaagaaattttacaatttccatcttaatttcttcttttacccactggtcattaaggagcaaattgtaagattttcatgtgttttgatagtttctaatgttcctctggttgttgattcctagttttattctattgtggtcagagaaaatacttgatatgatttaatttttttgaaatttctaatacttgtttcatggcctaacatatggtctatccttgagaatgatctatgtgctgaagagaagaatgtgtatttgcagccattagatgaattgttctataaaaatctattaggtctatttaattcagcagtgtagattgagtcccactgtttgttgttgattttctgtctggaagatctgtccaatgctgaaagtggtgtgttgaagttgccatctattattgtattggtgtttttccctctctagctctaataatatttgctttatttatctgggtgctccagtgttgggttcgtatatatttacaactgttatatcctcttactgaattgactccattgtcattgtacaatgactatctttgttcttttcatagcctttgttttgaaatctattttgtctgacttaagtatagcaacatttttggtttccattggcatggaatatgttttaccatccctttattttcagtctatgtgtggctttacacgtgaagtgtgtttcttttaggcaatatatgattgggtctcattttttttgttttgttttttaatccattcaggcaccttatgtcttttgactggaaagtttagtcaatttacattcaatgttatattaataagtaaggacttacttctgccattttgttatttgtttacagcttgttttgtggtcttctctttctccctttccttctttctgtcttcctttttatagagatgattttctctggtggaatatattcttgctttttactttttgtgtaactgttgtaagttacttttgtgtaactgtttttgatttgagatagccacgaggcttgcaaatagcataactcattattttaaactgagacaacttaacattttttgcaaaaacaagcaaacaagcaaagagaagattaataaagaccctttattttaacttcatcccagcccttttacctttttgttgtttctatatatatcttattttattgttaatgtcttgaaagtggtagttgttatttctgataggtttatcttttagtctttctagtcaagagatgagtagtttatacatcacagttacagtgttataatattctgtgtttgtctgtgtacttaccgttaccagtgatttttgtaccttcagatgattgttgcttgttaacattattttctttcagattgaagaactccctttagcatgtcttagtaagacaggtctggtgttgatgaaatacctcagcttttgtttgtctgggaaagtctttatttttctccatatttgaatgatattttcactagatatactattttagggtaaaagttttttctttagcactttaaatatgtcatggcagtctctcttggcctgtaaagtttccactggcaagtctggtgccaaatgtattggagttttctttatgttatttgtgtcttttttcttgatgcttttaggatcttttctttatccttgacttttatgagtttgattattaaatgtcccaagttagtattatatgagttacatatgcttggtgttctatacccttcttgtgtattgatatctttctctagatttggaaagttctctgttagtatccctttaaataaactttctacccagatctctctctctatcccctcttaaaggccagtaactcctagatttgcccttttgaggctattttctagatctcgtaggcattcttccttgttttttttttcttttgtctccatttactgtgtattttcaaatagtctgccttcaagcttactaattctttcttctgtttgatcagttctggtgttgagagactcatacattcttcaatatttcaactgaatctttcacctcaagaacttctgcttgatttttaagaattatttcaatctattcaataaacttatctgacaggattctgaattctttccctgtgttatcataagtttcgtcaatcttcctcaaaacagccattttgaattgtctgtctgaaagatcacatttctctgtcactctggggttgatcactggtgccttatttagttcattttgtgaggtcatgttttcccagatggtcctgatgcttgtcaatgtccaggcattgaagagttggatatttattacggtcatttcagtctgggcttgtttgtacccaacattcttgtgaaggctatctaagtattcaacgggaattgagtattgtgctctgtctttggtactgcagccatatctacattatgaggcacaccaatcccaataatagtgtgactctttcagaatcgtagaagtcctgtctcggtggtcttgggtaagatccgaatgaattctctgtattaccaggaagagattcttgcttccttcccttaccccaaacaaatggaatctctctcttcatgatgagtttcctggagctgaggaaggggtgacacaagcacctctgtagcctccaccactggaactgcatccagtcagacctgaatccagcatagcactgggtctcaccaaggcctgcagtgattattgcctggctaccaccaatattcactcaaagtccaagggcgcttcacttagcaggtgacaaatccagccaggcctgtattcttcccttcagggctgcaagctctccctgagcccagcagatccagaaattctgcccaggaggcaacatttggaatcaggaaccccaggaggccgcttagtgttctacaccactgtgactgagctgctacccaaagctgcaagataaagttccctttactcttccctctcctttcctcaaacagaaagaatctctcctcatggctgccacagctaggaatgtactgggtcacatctgaagtcagcgtggccctggatctcacccaaatgcctgcagcaaatactgcctggctaccattgatgtttactcaaggtccaagcactctttagtcatcacatggtggatcctgccaaaactgggtccttaacttcaaggtggtgggttctcttctgtccaagggtgtgtcgagaaatgtcatctgggagctagggcctggaatgggtgcctcaggactctgtctagtgccctattttactgtggctgagctggtatccaagttggaaaacaatgttctctcctttcccctttctttttctcaagcagaaagaaggaatctctcagaattctgagttgtgctgcctggggttgggggatgggtgacacaaatactttcttggccactctgacttgtgtctcactaggtcacatgcaccccaagtccactggcttctagcccagtacagcgccaagacttgcccagaaattgcagtccttgtggtgtagactgcctttcaactttatttagaaccccatagcattttagcccatggtggtggggctaccaggaactcaggctctgactcccagaatggacaattcctttctggctacagtaggtctaaatacttcttctgtgggcaccagctgaattatctcctgcattgctttctactgtgacaggcagcactgagttccactgcaaagtcctacaatcaccgtgctctccctttcccaaacacacagattctctctcagcaccatgagccccctgccaggaaatgggagtggctgtcaggaactcaagactatcttttctacactgttcatgcctctttccttatgatgttaaaaccaggtactatggtcactcacctgatttttgttcctccaaagatgttttcttgtgtgagtagttgttcaatttcctgttcctgcagtggagacaatcactatagggttctatctggctgtcttgctctgcctgctcaccaaaaggcacttttaaggcattgtggtatttgaaaacatcactgaagtggttatgacccatgcaaaaaaatgtgtgtgactgaatcctcccggtgctgttatttattcctagcatacctttgattttagattcaggttagctccatattctgaagtgcttccaattctgacttcctgcttctgaagtttagcccgagtactatagaagtccctcccagttactacagactccactttttttgagtccacgcagactgtggcatacaagcactctggattgctcagcagcattgtaaaaggatctatggggataaggtacaattagtgagctcctcgctttggcccctttaattcttgagattttcatttttctttgggaactaaaacctaagtatacatagtgataaaagctaaaggtaacataataaaaattatcttattatttctttcttttgcctaactgtgttctggaaaaaacaaagccatttataatgaaaaatcattaaagcaaaaattcaacattgaacatgctagtgtctgaacatgctttatgtaagagttaaataaaaattgagaaaacaaagcagttttcactggcttaaagtttgatatttgtatatatataattgccttccatgatgatgactgattcagaagggcatggcatttacttgacatgctctcatggcattctttctctccagtttcccaagtaagtatagggcttttatttttgaaattagtttggttaattgcagttgaccagggtgaactggccaaatagaacaccaagtaccttgaatgtacttgtgttggcacaggcatatatgagatgagaaagtcagagacggagacttctcctagcttcttttccaccttagccagtggcaaatatcttttctgaaaataataacaacatgcatttggttttgattgttattaaatttgtgatgagccacagttggaggtcatggctgcgattttgtaaaatagggtattggggaaggaaatgaggttaggcaatttcctgggcatgatttttcttacttttattcataaaggtaagaatgcacttataggacacatgcatataatgtaataatacttctcatctctggctgtacattaaaataacttggggagcactggagaactaccccctacccgtttcagagattctgatttaattggcctggcaaacaaccagggcatcagtagttgccaaagttcttcaggtaattctgatttgcctgtgggcatgagaaccacccatgttcctgaagacagcatttcctgaccgatagagccttgaaattagaacaatggaatctgtattctagtcctggcttcgccaacttgagcagtcttaacctctgtgaaattatatcagttctttgagaaaacatagttattattgtaaccaagctctcaaattcattctgctctaagaacttgggattctaattatctccttccagaaaaaacaaacaaacaaacaaaacactaatgtttaattacagatattaacatattgtttacaatgtaagaaatataaatatgaatcagatattgtctttgacctttggttattcactggctattgtcggatgctgggggggtgacaatgagttaactttaatagagtttcattaatacaagtaaatcatgcaaaataatggcagcaatcaattgtcttttaaacagagaagtcttaatctcgtgaagaaagtatgatttgagcttaatctcaaataggggttatagagcagcatttgcaaaggctctggagagtgcagaaaatgttttgggaacaaatagttaagggtggcctcattgattgatcctatagacaagaagttatgaaggcttcccaggaccagattgtgaatggtcttaaactcaggcactcaatcaagtataagagaaatagtaaaagtttgatagtgatattaaagagctttgcattttacattttgagaaatatttcccagttgccctccaggctccttcctgggtcagtgctgcagggaggctttaattggcaagtccgggaatcaaactcaagtctgaacgcaaaatccatgaggtccttcttaaccatcagaccatacggcctcaggcttttcatgtataccataatgagaaaaatcctttctaccttataactttgctgtgattgactatatgagatagtgcatgcatattttactgcatgcttgatacatattaagtgctcagtaaattatatatttctgtcctgtggtggtttcaacctggcaacctctgtacctgtgttccctccagcaatgaaagcatgcagactcagcatttttacctgtaccgcttagttacaccgtgattgacagcctccattacccagattcttagtatagtttctcagtcctctcattcaatttaattcaatagttactaaaatcttgctagtgctcagcagaccatgtagatggctgtgtattaggaataagaggatgcaaaaatgaatatggcatactgtcttcattccgggagcctgcaatccaatagtgaaaatagatgtagtcataaatatttaatacaaggccaatgtggacatagctttgattgcctgctggaggcagagaaagggcagtatgtgaaaatgtgatagttctttgtagtttattttttaattaggcctaagtaaaatggttggtttaagttgtaaacatttgacaaaaagcctaaggtactttggctcagaaattacagatgaattataatgaaactgcatattagaaaatagaggaaaacatgtctaaatgctcagtttgtgaattgtatctatctttcaataaccatgcaaaataaaagccaatgtattagcttgacaattgttctgcatctctactatgtccagcatatcaaaatatgttacagaattcagtaaaggaaaatttatttcctccaataaattatcaaacagtaaatcttgtcagtttctctaacgtgtcttaacttcaaatcactgatgtatttactcactaaacacatctataaaaatggcaatcctggaaaattgtctggggtatcttttgattagcattggtttttgtttgtttcttcaattttatataattatttttcatagttacagtcaatataggaaaattgaaagttaccagaagcctaaaatctgttaacagtttgtactaaaacttgaattcttaattgggatgcttttatcctgtaagcaatttttgcaggtcacctgattcacattagctaatctcctagagaaaattaaacatacgaacactatttattaaagtgaacatctctacaaaataatattaatgactagaaatccctcagaaagcaaatattaagtccttttatccatttgttaacatttgttttcaagttaaatttgtataacattaagatattgtaattgcagtgcttgtatcttccatcatactgcactgccttagtgttctcatctgcaatgcaataatacatattgagtaaagctaaatctggcttccaaccttaattaagaaagtgctgttatatgcagcaacacataggccttgcatttcccaatgcccagtgaagacgtaaattcctcactgcctgaattaatgctggcacacaggcacataaggaccagaatcttcatcaccagctcataatttttgattgctcatcgttggcaaagtactctaactaggcactctaatgggcacatacataaccaaacatgctgatgatgctgtttttacatctgagggttctatgtgagcaaaagaagccttgaggagataacagagtaatgctgaacatggcattttatgaactaaggaaaattactgaaagactagagacataaatgaatattgcccctcagatagaactcatatatactcttcataccagaaactcctttttgatactcaaaaggtaggctctctttctgtgaacaaagataatatttatagtagagctaccgaggaagatattaaaattgataacactctgaagaagcttgaggtcaatgctttggtaggggcatcctaaggggtatcttggagaaagaatattaagggatattaaaatcttttttttttttttgagagatggagtctcgctctgtcactcaggctagagtacaggcaccatcttggctcactgcaacccctacttcctggactcaaggtctccatggtacctgagattataggtacctgcctccatgcccggctaggttttttgtatttttattggagacagggttttgccatgctggccaggcttatcttgaactcctgacctcaagtgatccacccacctcagcctcccaaattgctgggattacaggcgtaagccaccgtgcttggccagatatatgtcttctttagtgaatagtaataacaatttacccataattgggctggaagatagttgaacttgtgttgactataggagtcatacccaccaattcaacaaacactttctgagcaaacccctattgccaaatactgttttatgtactatggataaatcataaataagaataatgttttctgctcttgagaatagcagtaaaaagtaaagtaaacaaagtcaacttatagtattatgctgaatataggaacatgtgatatgatagggacttactggctagaggatcagtctgaaagcatggatatctttggggtaatccagaaagagcaagaacaccagtgtgactggcaccaaatgatcatggaagagaggagttggagaggtaggcagggggtcagctcttacagaactgcccaactgccctctgacaatgtgaggagtttgaattttattctaagtttaatgccatcaattagaggctttattaagcaggggtaagtaaatgtagactctagagtctctgcttctaaggttcattgacgtatttacaagatcactctgatcatagtgtcaaaattatgttgtaaggtggtagaggcaaaagtagaaagagtcattgggataattcaagcaagaaatcaaggtaatgtggagttggatattagcagtggagatggagataaagggacagatttaacatgtatttaggggttagagccacaggaactcacatagcgatttgcctgcttgaggcaattaggagaccacataagacttttgatgtgaataaggattgtttgtaagggtagagaagttgccacaaaacaaagcatcatacccaatttttaacaaaaccgtgtagtgcctctgctacagaaatagtataggtagtgcagattataatccataaaggagaagaaaagacatgggagatgaatgcagaaaaaaatctaatgaaatatttaagggacagaagtctgtgagatgattgtggtgtggagggaaaaaacaaaaaaacagtttgggagtcaggagtcaggagtcttgaactcggaatccatctcaagtactaatccaaggtataattctgagaaatgagctttatcttttgaaagtcctgtctcctcatttgtaaaagaagagtgatgtggaagaagattgtctctatagtcactaatagcttaaaatgttcattaccccattagtcttttgctttagaaaaataatggctgatatacctaatgctagatgatgagttagtgggtgcagcgcaccagcgtggcacatgtatacatatgtaactaacctgcacattgtgcacatgtaccctaaagcttaaagtataaaaataataaatgaaaaaaaaagaaaaataatggctgaaagatgcatgatgaaaggttgtataattatgtgttctaaacaacttttttttactaagtgacagtgtattttaaacttagaagagttaagaacttagaaaagagtaaattttatccatatgaaatgcaacagtgttttacttaaggaatagtgaaattgtggaatatttgccttaagtattgacatagttatacattctccaaatagttaattaatttcctatgtactaggctccagaaatataaacatttttacatggttagataaatcatatataaatgaatcattacagagcacttaccatgtactagggcctgaatcattacatagcacttaccatgtactagggcctaagcactttagaattattaattaattctcaagatagttgtacaagacaagtattgttttcttccgttccacagatgagaaaaatgagactcagagaaattaactaacttgtctaaggtcacaaagttagtaagtggatgggccaagatttggatccaggatttctggttctaaggtctctgcccctaaatgctatattatatctcagatttataaatgaaagactgtgttctttctatgagaatttaacgcagagaagaagtttctatatttttatgataaattattctccatcattttgggaaaaaacaaagacacttaaatccgtggaaaggaattatgaagtaaaaaggaaaatttataagtcaaagactttttatgcattcagcagagttgactgaataaatagaacatacaatacagatttgtttacacaatccacagtagagtaagtttcaagtggattcatttacaacaggcattttgcctactaatctttacaatcagctgagtagagtaatttagaagatatgatcttcctaagggataaagggagaaggggagaaatgtttttggatatattttagaacttatattttccattaaaattacatagaaaaattgggcaattataggtttgtaactcttgcaaatcttggacttccttcaaaccatcaactaggttaccacaaaattaaattcacttgtttcacaaaagcactcattccaatcagttggaaaatgtagaaaggcttgtttcttctggattacctttatgccacaaagcaaacataacctattgcttttgcttgtttttctttggtttgatgtatatgagggaatagaaaagttaaaaatgttgagtatgaaaattttaggtaagatctaaatagaaaagtttaaaatatttagtatgaaattttagataagaactgacattgaaaaacttaaacatgtttgttgaattataaagtgccctttcaattacataagatagaatttatttattaaatataattatagtattatactatacattttaaattcgattttttgggaaatggcaattcatttactatgtacagattatccttgaacaatatgtgtttgaactgcatggctccactcagacgtgaatttttttcaaccaaacacagctccaaagcacagtatgcatggaatgggaaacctatgtaaacagaaggttgacttttcatatgcacaggtttcacagggctgacagtgaggcttgagtatgggaagatggtatacctaggggtcttggaatcaataccccacttatactgagggaggactatacatgactggaatatttggtcagccattacagctattttcctgactattttgtgtatagcagagtttctttcttagcaatgaaaatttttgtgggctgattgaccttaggtagttaacttttaatcatcgctcatgatgatccagacaccatgctaaacatgttacataaattgcattatgcatcatctcaacagatagttataatactattcttgtctccattttacaaaagaataaattcagacttacaggagttaaataacttacataaggaaatatatttcagccaataggatttgaatgtaaggcttctgcattaaaagatgcatacatcctgtccacaatgatatggtcaatattattaagaatattaaatatatctaatagttatgtctaagccgcacttaaagtttatcttgttttttgccctcagtctattttaagcactattttttaagttgtttatctttacaatgccacttttttctgttctcaccttcatcgtctttgtttactgataaatatttcttgtctgggtcaatgactttgtctcctacctggtctcattgcttcttttctcacgcttctttaataaatttggtatactgtcaacagaatccatgtatgtaaactctttatccttagttcaaaaacttctgtgtttagtataactatggaattctttaggccgccttataagacccttgataaccataccctattagctaccttatatattccatctttataccattcactttttgttttatttgagttcgtttcctctctttatatagaattttgtgatactcatttccatgcttacatctatttgctcattcttctcattctacctttccatagaaaaggtccagttaaaatgcctcatctccaggctaagaagctgattcgagctactctacttgatactaatttttacccttgttgaaactccaggtgtttattaatataccgccaatgagttatttaatctccgtgtctaatattatcttataagttgaggtttatactcattatctcttcagggactaggttttattcaacctatacccccctacttctctattaaatcctgaatgaatagtaactacaacttattatacatttatcaaagttattccacttcagaataatcaaagatgattgtacttgataatgcagtattagccaaacagttcttgcaataactgttatttttatattaattctgtagtttgtaaaagtgcaaaaatgaaaattacatatgctttcaaattaaaatatgtagtcaaacatgagagctaaatatattcatcaatatagcaatttgagacaaaagtactaaaattgcgggcttcaacataaaagtgtatattacaatttgcaaataactctaaatagtcagttcttgaatatggtatttctttgataatggatacagtaaaatgttatgttaattccaggtgtcttttgcaagtgctctttcaaaaaaagctgtatcagaatataatgtagcaatgttgactgaatataaaaaaattggttgtataagtcaaagaatatcaagggtcacttatttattttgttagtcatttatcagatacttattgaacacctaatatttgcaaagtacggtcttagagtatgaaaattttaatacaaagatagtttattctcacaagtgcccatactctgatgttaagatggtcaaggaatcaaaccactgcaaaacaatcaaatacttgtgtaatagcagcacatgtgatatgcaacaggaacagagaggagagacaagtttgtgtatgttgataacgcatttgtctggtccagtagattattttagctcagtgactataatatgttccaatttatggaaatttgatatgcatatgtataaaattgattaactgggaggggtttgttttgcataaaacaaggcctgctaagaatttttctgctatgtttaaaatatttacacatggatgaacatgtgtaaaaaatgatttacacaaaattttgtatgtgtacagcttttgattaatggaatggatttatagctttataatagaagactgtccttatggttccaggttttccagtagaaacacttgttataggttcatgaaatgctagaactgcttttgcagaagagctcctgcttgccatgaaaattggattatccaagcaccagcttacagatgatctgcctgggtgagaaatagtcattgggaaactcaggctcaggccaacagcattaatatatggaatggctatatagggggatttggtatgagccaaatcaaggaaccgtattccaatcagacccatcacatctgtaaaactgacatgccctagtctctggtgattacacagccacatagagctattgcaagcagggcattagaagttctgaatctcgagtgtctgctgttgctgcatatagcatttcacccttgaatgtgcccttgtaatccatgagaatctgtcatatccaaaccatgctgaatcgatataggtattctacttgtactggatagaagatgctattccagttttcttcaattcaatatttacagagcattccaatgaaatgttgatcaaagttttggcaagctattttaaaatattaatggaaaggtggtaaataaactatttagttacatgaatagttgttattcaatataaaaccctaattgcaataaataatacaaaataaaactcaaaatatcattatgaagttcaggcactacagctggactgtaaaaatggagggccgcaggctgggtgcagtagctcatgcctgtaatcctagcactttggaaggccatggtgggtggattgcctgagctcaggagttcaagaccagcttgggcaacatggtgaaaccccgtctctactaaaatacaaaaaaaatagctggacatggtggtgcatgcctgtagccccagttacttggcaggctgaggcacaagacttgcttgaaccctggaggtggatgttgcagtgagccaagatcacaccactgtactccagcctgggtgacagagcaagactctgtctcaattaaaaaaaaaaaatggaaggctacatatggtggaaatacattgggaacatccatctacttttcaaccaatggttcaatgatacaaataatcatttaaaccttgtatgataaatacaaacacatattatgtgaaaacttacccatggagaagatggattcgattaaaaagcttagaaattttaagtcatattgtagtatattatctttacaattttgaagacagcagatagtgaatattttttatgtctgctttgctgttattctataatattctcatgtaattttgactaataagtgtacattaactatgtgtacaagcaatgatacattcatatttgcacctctgctttgtctgcagtattgttccagtgaattagcacacacagaatacttagtattaagtaattaacaatggaattgagaagagatgcttctttatatgaaatgataaataacaggtattaagatgaggatgcatatgataattgcaatggtaggctacagaggaagagataaatgtggtaattattaccaggaatgtctcatgtcacacacacacacaaacacacacacacacgtatttgtataatgaaaagatgtaccaaagtttcagcataagaatcagagacacctggcttcgagagcctggcttgcttacgtatcatctctgtgaccttcagcaactgcctgagctttcatctccctatttgtaaaatgaggacattaatactcacatcattggctttttgtaagacttaaatagaataaatatataaaacatcaatttgtactggatgaaaattgtgattattgtattgattgccagcatgattaataactttctataaaaatgtatgctttccttgcttagtaaaaattgtatagttataattcaataatttttacattattttcctgtcctattcagctacagaaatgacacaaaatatatgacagtgggacattcaaaattgtcagattgaaaaatagattgtaaatttgttgctaaggcagcagaatatagggttgtcaaactttactgaggtgtcagagtatgtgatactttcagcagtgatgagtgagtttcgtcaaaatgttcaaatcacacatacaattcattcaattgaattgaatacgattcaattctaggttgaaagacgaatgtcttacttattttttacagaaaatgaggtgaccacataaaacattttaatgaaataaaagttgtgtaatacatttttatttctaagttttgaataaagcaatattagtttcacctcttacaaaaaagaaatatggttaatataatataaaacaattagctaaaactgtatatgccaattaaatcttactaaagactgttttgttatagtatttataatctgaatatccttattatattagttcgttcttacactgttagtaatataaagaactgccagagaatgggtaatttataaagaaaaaatgtttaattgactcccagtctgcatggctggagaggtctcagaaaacttacaatcatgggggaaggcaaaggagaggcaagtaccttcttcacaaggtggcaggaaaaatgagagtgaagtgaagacggaagagccccttatgcaaccttcagatctcatgataactcactcaccatcacaagaacagcatgagggaaaccacctccatgatcctatcacctcccaccaggcccctaccttgacacgtggggatgatggggattacagtttgagatgagatttgggtgaggacacggagccaaaccatatcactcaccaattattctttaaaagtgtgattcactccatcacttccctagattgcaaaataagcatggtgttccaaatataatgggtaactaatgatgagaactcgaattataggttagaatggacctctgtctaacttttggctttttccatatggccttgagcaaatgttccagttactcagtgctacataaaaaaacacccccaaatttaatgacttaagacaacactgatcatctattttgctcacaaatctgtaatgtgagccaggattggcaagggcagctcatctctgccccatgcagcatcagctggattggcaggagtggggactggaggatctacattctagatgggtccctcacttgtccggcaaattggtgctggttttcaaccacgagctcagccagagctatgagcaaagaacctaaattctccgcgtggccatctccatggctgcttggtcttcctcctgccacatgggtagtttctaaaagtaagcatcctgaagaatcagacgaaagctctattaccttttatgacctagcctaggaaatcatataaagtcacttctactatagtcacaagcacactgatttcaagagaagagaacggaggcctaacagttttgtgcaatgagtgtctataagaaattgtcaaaagaacatatgttttgaaaaatattgttggggcatttttttggaaaacaatctgccacagtacattatttaatattacttagcttcaggttcctcatcttaataataaaatggtagacacccttctgatcattttatacatatgacatttattaatccctcacaaccacccctgagttaagttctatcttttattcccattgtcttagtcagtttgggcttctgtaacaaaatatcatagactgtgtggcttaaacagcagagatgtttttctcacagttcataaggctgaaagtccaagatcaaggcaccagaagatctggtgtctggtgagtaccctcttccttatttgcagatggctatcttctgctgtcctcacatgtaagagggcagagaggtctggtttcttcattcccttataagggcactaatcccatttagacttccatcctcatgagctaatcacttcccaaagtccccatcttcaaatatgattgcattggggatttcaggcttcaacatcaaaatttggggggcatacacacactcagtcaataacacctattctacagaagtgaaaactgatgcacatgaaaataagtcgccttaaatgacagagcgagtaaactaaagaaacagaactcaaacccatgtgatctagtttcaaaggccacattctttatttactttgtagttaatttttgtaagaataaccaaaatattatatgcaaagtgcttatcaaagtgcctggctcattctgaatgttcaataattataaatggttttgttgtagttattattactaatatatcttatagtaagttactggatgtattctttttgaagacatttttctttatccataaaagcaaattcagtctgacttaaagagtatgcaataaagaaatattgaaagaaaagatgacaaactgtcataactagatggtctacacaaaatagtgaaacaagaataagaatctctgactaggggataaaaatactaaatagtatttcatttcaggatacttgggaatctgattatagattcactgagcacattttttaaaaccaaatatgaagaaagtaatattaatgtgggattaagtatggttgactaaaacatatctgggaatataacattaagtaaaaatcatgttagaagataaatgttggaacatttaaagggtgatcaatatttatagaaacaacatagtagcttctatgttgtatgagtattattaccagattatattcaaaatggtaataaaaatttagcctaatcctaaaaactgttgatgtaagtcttttggtctacataccttatcttaacttccagaacagaaatgcttaccttattctcacactagaaacagctttagaattttaactttgcttgtcactaccctcagactactaaactgtttctgactcttttccaaataatgctgtaaccttgacacttgtccatcccttgagtgtatgtgctttttttcaaatcatctttaacatataaattataaatctatgaatgagaaaagatgataaaagataaattgaaatataatacattcactttatgcttattaatggcaacttacctgagtttgccagtatggaaatatatattcatttcaggatattcaggaatatggtgttagttttcctgtgtgtgtgtatataacccctgtttctaagttcatgtgtcaaaatagccacatcaagaaacaaactaactgaaaacaacagtatatgatttctatgttgatgtcctcttctctacataaccagaagtttaaaaaccggactgcttgtctgatacctgggtgctggtcttggcctagttcttaagtctttggcatgttaaatagaatagaatccacatgtgtgcatttgggagtaagcccaagagttcataaacaagtttatggattgcttttctaagcttctctgtctctccatgttctccgggtagtttctggtttcctgtggtttctctttaagatcccttggcaagaaggctgaggctttatttcctccactgtgctgtgcccttctgcaactacattcacttccagggccatgtgagaggaggacagagagaaaaagaaacataatggaggttgacccaaccctcttggaaccacagcttcagtgaacaaacaagaaaatttactttcttaagaatttcggctcctgtgtttcccatttctggccaccaccaccaccatcaccatgtgattgcttgaggactgggcaagagttaagcaagaaaagaaaaaacgggtggggaattgccacattctctctgagcattatgagttctgattcccactcctaaagctaaaatgagcaggcttgtcctggagctgtctatggcctggtgtccacttccaagtttccagttcattcagggcaggagagggttgagtgggaattagaaagatgaatgagaacaatggtaaacttatcatcagcccagcgatacttcacattttgtcttctccaatgtgcctacttctactttgagtcctcaaattgctgctttgtgtattcttcctagattttacagttaagcgggagaaagaggatgccatgtgcttactctatcctttctggaacaagagcattttactcttattctttgggatgatattgatgtaacttgcagtatatttatgtaggtctaatggtttttctatttgtttattcaacgggaagttcattaaagcatttttctgatgacagtaagaaattggaattagtaccagtactcctttacatacattatctaatcataatctcatgtgttctgtgtgtgtgtgtgtgtgtgtgtgtgtgtgtgtgtgtgtgagagagagagagagagggagagggagtctcattctgttgcccaggctggagtgcagtggtgcaatctcagctcactgcaacctccgcctcccaggttcaagtgattctcatgcctcagcctcccaaggagctggaattccaggtgcctgccaccatgcctggctaatttttgtattttgagtagagacagggattcaccatgttggccaggctggtctcaaactccagaccacaagtgattcacccaccttagcttcctaaagtgatagggattacagtcttgagccacctcacctggcttcatgtattctttacagtagccatcctctgaagaaagttggattgaatattttgaagcacaatactattgctatacgcccaacagaaaagcgtggagtgccactgcactccagcctaggcaacaagagcgaaactttgtctcaaaaaaaaaaaaaaaaaagaaaagaaaattagtggtatttcaatcactgtattcatatttagtttgcctttaatatatatctttctctaaaaatttactttgatttttgccatatgtataatattttcattgttattttaagcaatcacataaagtttctcaaattataagcgtattttgaaataaaaatttcaaaacatatttcagaaatgaggatatgtttgtaatttgattattcttaactgaatatacaagcttattatttatagacttggatttggtgaatttgagaatttcactggatgctatgaggttattcagaagaaacaacatatgtgtgtttattcacccttaagttttgcagttttcttatgtttaaattccttaatcttctctgcttttgctagtaacttgacaacaatatttattgtacagcagcatctagaaaacataaatgatactgtttttgccagtttcttaaagttctttcaagaatgctattattttgagaaatgatgcagatcatatattttactgataagtcatgcaggtttatctaaacttacaggctattgaacaccatgagggaaaagcagtcgattatattaatatcagttcctgacacacaagacgcaattcaatatttaatcaaacaatgagaaccacacagcatgatatgctagctaggatttctcatgttatttttttgtcttccagttctctgataataaggataagcctaaaaacactgctaacaatatatagtctaaccactcaattttgaaagtatgagtagaacagattattcatttcttattttttgttttattagagacatactttgtgtgtgtgtgtatgtgactgaaagtcacaggcttcagctgtgtttcaatcaatacttcaatattctgatttcaattttctgtggataatgaaatttcaaacatctataagagaaattgttgtataagataattagtgtagccaggcatcatggcaggcatctgtaattccagctactcaggaggctgaggcaggagaattgcttgaacccgggaggcggaggttgcagtgagctgagatcatgtcactgcacttcagtctgggcaacaagagcaaactttgtctcaaaaaaaaaaaaaaatagaaaattagtgatatttcaatcactgtatccatatttagtttgcctttaatatatgtcttctctaaaaattgacttttgccatatgtatgacattttcattgttattttaagcaatcatgtaaagtttctgaaattataaacatattttgaaataaaaatttcaaaacatatttcagaaataaggatatgtttgtaatttgattattcttaactgaatatacttcctccaattatatgatctgaaatttaggaaggtaaaagctttttgttaaacatagtttattgaacatattagtttacctgtatgcctttttgacaattcactaacaggaataagggtatatggaatgtttactctaacaagaagaaagcaaaagagaaagggaaaagaaactacatcaggtgagaaaagtcaatgtctgtattaggtcatttctttattgctataaagaagtacctgagatgggtaatttctaaagaaaagagttttaattggctcatgattcttctggcagtacaagcatggctccagcatctgcttctggtgaggggctcaggaagcttctaattatggtagaaggagaagcggagcctgtacatcacatggtgtgagcaggagcaaggggtggggaggttgtggtcctagacttttaaacaaccttatctcgcatgaactaactgagcaagaactcacttataaacaggggatgcttctaaaccattcatgaggaatccacctccatgatcccgtcatctcccaccaggccccacctccaacattgagaatcacatttcaacatgagatttcaagaagacaaatatccaaaccacatcaatgtcaacaaatttcagaaaatgaaaatcaagtggaggatcaataactcatgtagcaatggaaattagtatgactacttcagggggataggcccctttcatctcatgcttttcttttgggcatatagcaagcagtggaattgttatatcaaatggtaggcctatgttcctacctatagtaagtactgccaaacagttctctaaagtggtagcacgaacttaaactcctccagtgatattttagagttcgtattgctccatattctcagaaacatttggtattgtgtgtttatttcatctaagtattctggtacaggtggtagtattacactgcactttaaaataagttatttaaatatgtatttgagaaactagatatagtagataggaaaaggacattatagaagacaatgaaatatgaagacaaaaataagaatttaggatgactcaagcagtctgatttttacttttggtcaagatggagtaacttctactatctgagataagaaaactcatttaaaatatgtggaaaaaaacatatttaagacatgagacatcagataaccaagagatagtaattaaaagaggaaagccctacaatttccccaacttactatttagggtaaatttttaggccctggcacaggagaaaggaccctgataaaaccttataaactccttaatgcactattaatcgagaagacagatctgagagttcagggaaatcaaggtagcaagatttcacaatgtcagtatgacagagaaaagggctttccaaaagacaactccagagaggtgcagaggttctctgtgagtgctcacttaaattttactaataaaaaaaattcaacaaagaagataaaacagatggtaaaaagtatgtcacttttctaaaagaacataggaaaagaggaaaataacaaagacatgggacaaatgcaaagcaaatagcaaggtagaattaaacctaagaatatcaataatcacattaaatataaatgatctaaataccccaattaaatggcatagattgtcaaatagtagttttttacaagaccgaggtatgtgctgcttccaagaaacatactttaaatataaaaatgaaaataccctaaaatgaagaggtataagaaaacttctgggattgacagatatattcgctatcttgattgtgccaagttttcacagttgtgtagatatatcacaatatccaatcatatgctttatttgaagttttgtgtatgccaattatacttcagtaaaactgtgagaaaataatatggtccatgtagggagtggcaagaagtataaaatttctgtagcagtggaaggtgattttggaaaaatagatgtgagtccatctctgaaggaaattaaatgctaatcttagtttggactttattctagaaaccaggtattgtcatatttttttctgtgaaaagccatagagtatgtactttagactttgaagtctgagtcaaaaatctagaatatcatatacttatataatcatttaaaaatataaaggctgggtgcagatgcttatgcctgtagtctcagcactttggcagaccgaggcaaggcagatcactgaagcacagaagaatgggaccagcctgaacaatatggcaaaaccccctctctacaaaaaatacaaaaattagctggcatggtggtgcatgcctgtagtcccagctacttggaaggctgatgtgggaggaccacctgagcttgggatgtggaggctgcagtaagctgtgatcatgccactgcactctagcctggatgaaagagtgagaccctatcttaaaaaaaaaaaatgtaaaaccattcttagctctcagtctgtgtattagtccattttcatagtgctataaagaactgcctgagacaaggtaatttataaaaaatagaggtttaattcactcacaattcagcatggctggggaagccttaggaaacttacaattgtggcggaaggcaaaagggaagcaaggcacctttttcacaagacaggaggaaggagaagtacctagcaaagtaggaagagccccttataaaactatcagatcttgtaagaagtcactcactatcatgagaatagcatcagggaaaccacccccatgattcaattacctccacctggtctctcccttgacacatagggattatagggattataattcaagatgagacttggttggggataaaaagcctaaccaaatcattctgtccctggccccacccaaatatcatatccttttcacattatgataccaatcatgccttcccaactgtcccccaaagttgtaattcattccagcattaacccaaaattccaagtccaaagtctcatctgagaaaaggcaagtcccttcaacctatgcacctgtaaaatcaaaagcaagtgaattagtttctagatacaataggggtacaggcattgggtaaatacacccattccaaatgggagaaattgaccagaacaaaagggctccaggcctcctgtaagtctgaaatctagtgtggcagtcaaatcttcaagctgcagaatgatctcctttgacttcttgtctcactttcaggtcaccctgatgcaagaggtgggctcccacagtcttggacagatctacccctgtggctttgcagggtacagctccactcctggctgcttttatgggctggcattgagtgtctgtggcttttccaggcacatggtgcaggctgtcagtggtctaccattctggggtttagtggatggtggccctcttctcatagcaccactaggcagtacccaagtggggactctgtgttggggcttaaaccctacattttccctcttcattgctctagtagaggttctccatgagggctccacccctgcatcagacttctgccatataatgaaatattataataaatgttaatccaggcatttccatacatcctctgaaatctacgtagaagctcccaagcctcagttcttgtcttctgtgcacctgaaggcccaacagcacatggaagctgccaacgcttggggattgcaacctctgaagcaatagcccaagctgtaccttggccccttttagccatggctgaagctggagtgactggggtgcagggtgccatgtcacagggctgcacagagcagctgggccctgggcccagcccacgaaaccttttttccctcctaggcctccagacttgtgatgggaagtgctgccgtgaatatctctgaaatgccccagaaatattttctccattgtcttggcaattaacattcagctccttgttagttatgcaaattcctgcagccagctttaatttctccccagaaaatgggtttttcttttctattgtatcatcaggttgcaaattttccaaaattttatgctctacttcccttttaaacgtaagttctaatttcaaaccatctctttgtgaatgtataaaactgaatgcttttaagagcacccaagtaacatcttgaatgctttgctgcttagaaatttcttctgccagataccctaaatcatctctcatgagttcaaggttccacagatctctaggacaggagcaaaatgctaccagtctctttgctaaagcatagcaagagtcacctttattccagtgcacaacaagctcctcatctccatctgagcccacctcagccttgacttaattgtccgtatcactatcagcattttggtctgagtcattcaacaaacttctaggaagttccaaactttcccacatcttcctgtcttcttctgagccctccaggtctctagaaagttccaaactttcccacatcttcctgtcttcttctgagccctccaaactgttccaacttttgcctgttacccatttccaaagacgcttccacacttttggtatctttataacagtaccccactctctttggtaccaatttactgtattattcaattttcatactactataaagaactgcccaagattgggtaatttataaaggaaagaggtttaattgaccaccagtttaacatgtctggagaagcctcaggaaatttacaatcatggcagaaggcaaaggggaagcaagggaccttcttcacaaggcaagaggaaggagaattgcctagagaagggggaagagcctcttataaaaccatctgatcttgtgagaactcactcaatatcacaaggacagcatgggggaaaccacccccatgattcaattatatccacgtggtctctcccttgacacatggggattatgaggattataattcaagatgagatttgggtggggacacaaagcctaaccaaatcagtctgtacaaatctgtgcagtggtctggttttgcaaaaaggctaaactcttacaatagacaatagagaatagcatagccatatctactatttagaaatgtaacttgcagaaactgtggagtggatatgagcagggagaaagcagagaaaggcagacctgagatgaatgcactattccaaaagatgtagtgatttaaataataaatctttattattatgggggaaaacttaaaagtagaaattaaaaaggtaatgcaggctgggtgcagtggctcatgcctataatcccagcactttgggaggccaaggcaggcggatcacaaaagtcaggagctggagcccatttggccaacccggtgaaccctcgactttactaaaaatgcagaaattagatgggcatggtggtgcatgcctgagaacccaactcgggaggctgagacaggagaatcgcttgaaccagggagttgaaggttgtggtgagccgagatcctgccactgcactccagcctggtgacagagcaagactctgtctcaaaaaaaaaaaaaaaaaaaaaaaaaaaaaggaaagtaacgatggtctattcccaaatagatttttctaaaggaaaaaataatagaaaccactttgttagataacctgtaactttcctacatgattctgtagaatatagacatatgttggacaacattcttatctccactcgcttgtttcttgaaagcaagaagtttatacatcctataatataaacagaaaaataaggaagtagtagagaaggaaagaatatataagaaagaaatttaaaagttctcaagacatgagtactgataccccatttataacccaattctaacaaaacctaagaccactaattgaatagatacacagaatacttgtgcaattatctcatgttcggtattagcattcaccatttatttaccatcattccatttttacagtgtttataaaaactaaaggctgggtgcggtggctcatgcctgtaatcccagcactttgggaggccgacgcaggtggatcacttgaggtcaggagttcaagaccagcctgccaacatggtgaaacccgatctctactgaaatacaaaaattaggcagatatggtggtgggtgcctataatcccagctagtcaggaggctgaggcaggagaattgcttgatctgggtgcagaagtttcagtgagccgagatcgcaccactgcactccagcctggacaacagagccagaccccttctcaaaaaaaaaaaaaaaccaaccaacaaacaaaaaccctaaaacctaaatatgcctgaaatacggtagatattgtgcatactgtgatatgtgatattgaggcccatctctggcttgtggcagttacataaagctgagataacactcgacacaatagttgtaatctaatatgatatgatctgagagttatatgctgtatactattaatgtgtgctatataagagaatgtgagtgcctcaataataattttctaacaacagaattctttatttttaaatgaaatattatactaaatgttaatattgaaatagagaaatattgaagtaacccaaatatattttatgggttcaaaatttttaggatttcaaaggcaagttgatgtacaaaaacatttgaaatcagggatagttgaaagttgcagctcctatatccaatttatatatgtattttttgcattaggagtaatatccaagttcacattaataataatttcaaatggaaacttgttaataactaggtcatcttgcaatattagaataatcatttttcagacacagttaaatcactttcaagatatttactatctgttttcatccctaacctataacacattaagcagaaaacatataaatctatagaaagatgaattgtgccattaccagaccatgcattaagtagatatgcataatcttctacaggaatttaattagcagagtactcacacactatccagttcaattaaacaagtatgtatcgagcacctacattataacaagcactaagcaccggacaaatctgctcttgtggtgcttacagccattaaacaggtaattaccaaggctaactaatgcggaaaaggcccaggtcctttgagaaactaaatttggcctaagaagtcagaatggccctcttaaagaagtgcgagctgaaagataagtgaatcacagagtcatcggggttataaggaattggcaacatacgtgggtcatgaggtagagatacagtgaatagacttttcaacagagaagaagccttaaagcaggagaaagagcatggtaaaaccatagaaattaaaggagatctttggcaattcattcctttatttgccaaatatacctcatttgagggtctaataatgcctagcactgttctagaccctggaaatgcattttagaaaacaaaacaaagaaaaatatctcccttattggagcatacattttactgtggaatgatttaaaaattaaatgcatcatgtatcagatgtgaagttctttggagtggggagcataatatgaaatattgcagcagggtgtagcaggaagcagggaaggcttcattaatttggtgacatttgaacaaagacctgatataaaggaagggttaaagcatgcagatagctgagtaagagcaagtgttaaaaaaagccctgttgtgggaacaagcttgggtgtccaagattctggaaaaggccagtgtggctagagcgaagtatctgaaggaacaaaaggtaggaaatgaaaagcagagtcactgggggtggggagcaaaaccatgcggtgcttgggaggcagttatcaaggcaacagcttctactctccgaggaagagaaagccaatggaaggctctaagtccagtcataatacagtcttatacatgttttaaggagatcatcagctactgggttgaccataaattggagaagggcaaagccttaacggagaaggtgcaagaagggagtatcttcatctgatgtggttggagaggtaggcagggccaaatcatgggcaacgttgtaatccaagttaaatattttaaactttaacattaatatggtcggaaattataaaaaatttttgaatagaagaatgtaatgaatagatttctgtgtttaaaattgtgctatccagtatggtattcactagccatgtgaggttattgggcacttgaaatgcagttagtttaaattgagatctgctaaagtacatacaggatttcaaatacttcgagaaaaaaaaaatttaaaatccaaggaatgtaaaatatttcaatggttgatttaatgttgaaatgataatattttggatatattgggttaaataaaatatattattaaaatataatttcacctgtttctttttagtattttaatgtggctactacaaaatttaaaattatttatatgtgtctcactttatattgctgttagacacagtgtatttagaagatcactctgtctgaagaatggattaaagtgggcaagaatagttgctgagaggctagttatgagactgttctcaagaacagttcgaatatcactagcctattctaaatatcttagggagatgttctaagcattctgaaaagattctaagaagtgggaaattaacagaaaacacgtcagataagaaattatttaaattcttgttttagctaccaaagaaaataagtaaaaggtaacaatgtcttgctgcacagaattaagttataagcacgctactttatattctgaacaatgtttttggctgaaatttgcatggctgattaaaagaagaaaacaatatgcttataattcttctttatgtgtcttataggttctatatatgtacatgtaaaaatatcttttatattgtggttctatggcatacatattcctaattaattttaaacggtcttattctacagaataacataaaaaaccttttaaataatatttaaaatgttttaaatattactttatcttaaagtaatattttaaataccactgcaatatttagaatgtaagctccccatttagatttatatattctctataaattgactagtatgttagaattttaaatattgttatagattaaaggtattacttcaatttcaggtccaacttgttaatttttgactgatttttttttttgcttttttgggtttttttgtttgtttgtttgtttgttttgagacggagtctcgctctgtcgcccaggctggagtgcagtgccgcgatctccgctcactgcaagctccgcctcccgggttcacgccattctcctgcctcagtctcccgagtagctgggactacaggcgcccgccaccacgcccagctgatcttttgtatttttagtagagagggggtttcaccgtgttagccagaatggtctcaatctcctgaccctgtgatcagcccgcctcggcctcccaaagtgctgggattacaggcgtgagccaccgcacctggcaattttgggctaattattaacagacctatcctgtcgaatatattcagttattttaaactgcatattttagtagaaaacaattattttattggcaaactgtataaggtagatttattgactattttgtgatacattgtcataactgctgtcataagatcacatttagtaattatttttaaacaatacttcaattatgaaaatgttagcaatgtttctcatatattatttatgtattctgaattttcaaaattttagaacaatatgttaatgataaccttttttgagtgactatatactatttatttattaataagttattgaagagactattgtatatttgtgtaccaccactcctcattgatgttgatattgaataaccaacctcttgatagtaattttactgtgtggaattggtaattttgcttcttttgaattactagatcatttataaaaatattattataaaagcaaacataaactatcaaaaaatagagttacagcatatacaaaagaaaatttagccactaagaaaggtgtcaaagacatactttcaccaaattagaattttcttcttgactactcagaagaactgaagggaaaatagaatgtaaatacattttgaacagaatggtttaatgttatttaatgccttctctgagaacgacacaaaatcattttccttactgccagtcatgggcatccccattcttaggtaagcactgatattttgtgtgcacgtgcccgtgtgagtgtgtgtgtgtgtatgtgtgtatgcttgaggtataattttaaaaattagcagcctcagctaaaatatgattgcattgtggttttattaactctcaataactaatttcatttgttaatcttaatatagatgtcttctctatgtatgtgtaacactgtactctgagatccaatgtgaatataaattaaagtatgttgtacatgtacaaataaaagaatcctagcaataataactaaaaaagtgtttttttctctttttacagcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccagtaagtctatacattttggatttggaaattctgtttccaacccttttggtcttttcattctaaatttaaaaaataagtaaatgtacaaaatcttgcattatcaatgccatttgtctgtgataacagtcaaggaaaaagcttctctctcttctcagcatagttgcttttcaactctttgtaaagaatgggtttactcctcaaaattcatttggattcatgatgtacaaatgccagcactggtttgaggccctacaagttttccttatccataatctgtccttaggaaattatagcagttgaaggctgcatgagaagttatgaacaaaacttctgttctttgcttcaacccttgaccattttaaagcatatcaatttaggaccatatagttaacgcgtgagggagattccagaggaaactttaaaagtcattgtgttattgttatgtagaaaagttcaagttcccttgacatttatctttaaaggcaggtatttttgagtttttccacatttcacctcttactttctctccaatatttttggttagaagcagtagaatgttaaatctaaatgtgaaggtcattttaatgcatacaccaagaattttaaatgaattgtattcttctattattaaaatattgtaaaatatcagtacatttaaaaaataaaagtgaatatattaatacattgctaagttatgcaaaagtaaaataatcaccccttagattttttttaaagttttgtttaatatgttaacataaaaacaaaaaacacaatatataaatttagaaaaaggtagaggagacttttttttttttttcgagacagagttttgctcttgtagtccaggctggagtgcagtggcatgatcccggctcactgcagcctccacctcccggattcaagcgattctcctgcctcagcttcctgagtagctgggactacaggcatacacccccacgcccagctaattttcatatttttagtagagatggggtttcaccatgttggccaggctggtctcgaactcctgacctcaggtgatccacctgctttggcctcccagagtgctgcgattacaagcatgagccaccgcccctggccgaaactattttttatgaagagttacagcttgcaaggtggccatcctgcaggctgggaaatatagcctctgaccaagacatgcactttgagggtggtaagaatgacagggatttacgctgagtgaggtggtcaaagacacatattaaataacgctataggagtcatgaaatttatgaaagcagaaacatgcacatgggcaattgagcttcatgcctcagcatgggacccatgtacaaaaaaatggccatgttagcacaacccaagggtggagttttcagccctctgatgtcaaaaggtgaagcagaggacgtagaaaccctcactgagcatactctggactggccagaactactccgtggttggtggtctcttatcaggaaggaagctggttagttgttatgtctaaaccacagaaagggaggggcagcatcagatagttgatatcagcggtggagtgggtctttaaaaagggctggcttctctttaacccttgaagaaggaagcttaatggtagtaaaggagggaggtgtgtccagcctctcatctcatcatcatagtcgggatcccagttttaaggtttctctggggtaagcttggccatgagggggtctgttcaataggttgtggaattcggattttatttaatttttatttttataacaatagtttttggggaacaggtggtgtttggttgcatgggggaagttcttttgtggtgatttctgagattttggtgcacccatcactcgagcagtgtacactgtactcaatgtgtagtcttttatcactcactaccctcccatccttccccactgagttcccaaattccattatatcattcttatgttgttgctcctcataccttagccaccagttatgtgagaacatatgatgtttggtttgccattcctgaattacttcacttagaataatggtctccaactccaggttgctgcaaataccattattttgttcctttttattgctgagtagcattctatggtgtgtgtgtgtgtgtgtatatatatatatatataatgtaaatgtcatataaatgttatatatatatatatgtcacattttctttatccacttattagctgatgggcatttggactggttcaacatttttttgcaattgcaaattgtgctcctataaacatgcatgcgcaagtgtcaaataatgacatcttttcctctgggtagatagatacctagtaggggggattgctggatcaaatgatagttctccttttagttctttaaggaatctccataccgttatccgtggtagttgtactggtttacattcccaccagcagtgtaagtgtttgcttttcaccacatccacatcaacatttatgattgtttgatttcttaattatggccattcttgcaggagtaaggtggtatcgcattgtggttttgatttgcatttcccttgataattagtgatgttgagcattttttcatatgtctgttggcagtttgtgtatcttcttttgagaattgtctatccatgtcctttgccaactttttgatgggattatttggttttttttcttgctgatttgtttgagttccttgcagattgagttcctttgttggatgcatagtttgcaaatatttcctcctgctctgtgggttgtccattaactctgctgattatttcttttgctgtgtgaaagctttttagtttaattaggtcttatctatttgtctttggttttcattgcatttgcttttgggttcttggtcataaactctttgcataagccaatgtcgagaagaatttttctgatgttatcttctagaatttttatggtttcagaacttagatttaagtctttgatctatattgatttgatttttgtatcaggtgagagatgaggatcctgtctcattcttctacgtgtggcttgccaattgtcccagcaccatttattgaatagggtgtcctttctccactttatgtttttgtttgcttttatttttatttatcagttacataagtcagatattaaggtgaacatttgcccttcctggtgatgaattggtaccaaaattttgcttattttatttacttccatagcaagcaaaactagacttatgtaatgtcacatatttcttagaggcatttcttagagatgtcccaattttttaaacttaactaatgcagttcatagatttgtctgtattactatagatcttccttataaaatatttctatggaacacatttaataaaaatgtaatacattcattgttgctattcattagtagatgtaattttggctttctgattgtaaatgctaagtgactgctttcttcagaaaattacagcctagaaaattactacttaggtattttttttcctgtgaacatattttaaatttataaatagcaaaataaaacttcttaatataatttctcacttatggaaaaaagtttttagcagacaaatcttcctattactatacatgcaatctttcttgcatggttactgaatagtattatatatagtatggacaacatactacagtttaggtagtttgtgatatttcaaatagttacagacctgtcaggcatgtatccctcaaaacctatgtaggaaactgaatggagctttctaagtgttagaggaaaatatctttttattttcttaggaggctataaatagaaaattggtaaattgaggaaataagttcccatcaatgtaaccctttagtaaagtagtatagtcaataattgagaaggcttagagttattcagcatgacaaactagtcaaagaaaaataaatatgggctacaacaaggtctatgaatgtgataagcttgtcagtcatttttgaatcagatatgtgtatttttccacatcattttatgtcacttaaatttgctatcatttctaatttccttcctttaatgcttaatattataaattatatttcagaaatgctagcctagcttgtttattcaaagtagaagcaaagaaaggtttaattctgtcatggctgggcagaattttagacagggaagagcatgccattgttgctatagggcaggaaaaataattttccttctacgcttcatagttcttagttgagacagactccagtaacaaaagagattagaaagagaaaagcaaacagtaatttactaacatgtacctcgtgtatacattggacatacctagggaatgagtaaatctcaaagaggtagctctgagtttaggtttaaataccatcttcagctgcagcaaagaaagaagagttttgggtggcggagcagtaatggggaggtaaaatcacagtaaaccaggacaggatttgttatgttgatttaagtcagtgccttcttcatggataagagtttctagtgacttagtgatccttctcttcctgagaagacagagagatacacttacaaatggagatttcctttgtagatacaaattttccataggaaagggtgatttctactttgttttcagagctgctactgtgtctgcagtttctcaaataaaatgactcaaaataatccttatgccaaagaggcatatttttgagtggcgtattctggtctcctatagccatattttagggtgacatattctggtctcctccagtcatattttggagggcataatttgatctcctacattgttatcaatgatccaaagagagaacccccaaagaaaagtgaaatatagagctttagtcaagttttcctagtccagacccaggaagctttctttctcaaggcttctctcttctacttttttaagagcttacttactttgtttggcaaagactcagcttcatgctgaattcactgtcttttaaagccagattttctcagagcgaatcttggtgatacaagagcaaacggaaagctactctttcaccctctctgaatgtttactgatatgaactgacaatagccagattaagagaagaaaaatgcgtagaaatgtattaatgtgcataagcatggtgagggggcatataaaacatgagacttgtagaaggtccagatggtgaagtttatataccctctttgtaggggaaaggaaatggggcatgtagacaattggagggatagtaagtgatttttaggagaaatgagtgcacccaaggaacaatggcctgggagaaagttcctctgaggtctgagggaggtagtgaagaagatgaagggtggaactttagtatgaagaaaaatagtgttattatgcagataaagtatctcaggtaatccctaggagctgccctcagaagaatagatgaaatgtctttctgggcttggtgatgacttatagtcgtttcttttttccagtggttaatttttgctggttgtttgacaagactcctagggaagggcttttaagacaatgcatttcttcctggatgaagttcccttaaacaaataaagaaacttcagagaaatactcctatttgtgctgtgggaatgaaaggggatcagagagacaggttgacaggaaaggtcagagagagattttggtttcgaggtttatttctgaggccctgcagtttcctctaattcaaagaactccacatgccaaaggaccacatttttgggtgtgattttctgaaccccaaaagcatttattagatatgtaaggttgggcaaattatttaacttctcttgactccagttgtaccatccatattgataacaatacatacctcatactgttgtcacaatgatttaaatgagttaatatttgaaaagtgctaaaaacagtagcttgcacataatgggtgctacataaatgcttgttaaattaaaaagaaagctgttctcttacaattcgttttgaaagagtgtctggtaagttaaaattcaaactattagaaattttatgttgatgctattttgtcaggttcacggcttccatcatttgtattcctgcaaactaaaaacaataatgataataatatactgaatgcctaagaccttttcacaaaatatattaagtcctgcacctctaagcctatcatctgatattgttagcagtggcaaatctaacaggcctgcagcgacttgattcctacctcctcataggaaagaatttggctgaggggcataagtcagtatgagaccaaggcaagttttagaacaggagtgaaagtttattaaaatgtttttggaacaggaacaaaagaaagtacacttggaagagggccaagcaggcaccttgacagttccagctgcctcatttggccctttacttgaggttatatacattggcatggttccagggtttctgtttcttctctcctgattcttcccttggggctggctgtcttcatgcacagtggcctgctggcactcgggaggggccacatgcacagtatgtttactgaagttatgcacatgttcactggagtcattttttcttactgagtgtttctaggggaaggtcatataccggtcaaactctgcaattttgcctcttatgtacctgcttgagcccactcgtccaattcctgagatcttattggtaagcagctgatcaccagcttcaggtgttttctatctattgggagaccactgttccctggcaccagctgccaccaattatggttttagagagatagtttaacagccacctgaccatcacctggtcattgcctgacattcttggggtggagggccctctcctgccctgttcatgtctgcctagctgcctactccatcaatatcagtgaggtagtctgaatcatactttgattagtatggagtgaccctagcagttattacaatgtatgcaaaaaaaaaaaaaaagcaagtaccataaacttcaaaacattatgtcttctaaaacttaaaagatgagattgttggggaagaagatcagaaaaatgacaagttaagaggttgttgaacaattacacttaagaggttcatggtaagtccagcaagatatagaacttttggggccaggaatcgaacaagcagtcaatctttcctgtttttcattaaccacaaacagtagcaatattttaatagatatgcattctctccatgctagatattgtatttctatgaatttgccattatttatttcctttattcttatggtgtattatctaagagttggaatttagatcatcagtcattcccattactatctggtgtcttggtcaatcttagcatttaaaacggtgctttcagagaaccttctagggatttaaaaggaagcattttttggtgtcaggggtagagagaaaagtaactaaaaatttcaagtatgtgatgaaaccattttgaatgtatgattaataaaatgaagaactaaaattgtggaaatgagtaaccaaaatatttggccagtaaatggcctagtaggtgaaaatttcatagataggtataggaggcaatcatataaatgataagattttaaggatgctaagaagcccggttccttagtgattttctcaaaacaacagcaacaaacctaaaatttttctagtacaacacagcatgagattttaccattaagagttttacagatttctttgggtttgtagagatggtgtctttttattttataatcctaatttattcacataaagattattaggtgtctcaaatggctacagtctaaagaaaattatgtctcacattcaaagctaatccttccaattgttgggggatgatctgatctttcaattttctgttgggcctagctggttttgtttatctcctctactgaatttttgtttctgctaactccttccttagaacctatagtatatattcaaatttatattatcaaaaaaaatgctcccagtccaatttttctcttctctaaaacaaataccttggaaaaatcatcgtcattggctatgtctacttttcacttttaatttgctttttactctgttgcatttagatgttcccattcactctactacaagaagattttgtttttactacttctagtaaactgcataagaaaaattcaccaatgatcttcattgacattttgtattagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttagggcaggcatttcctgactgcccccctcaaaataaaattattcgcagttactcctttttatgtcattgtgctttcttttttatagattatatcattcttagaaaatacttggtttatttatatacttgcttcctcatttgttgtcattctgtccacaagagactacaaggtacctggcatatagtagacactaagaacctgatgaatgaataactaataatttcaagctcaacctgagttagccagtattattgctttctctctcagactgcttatcaagcctagcttttgtttctgtgtcctgatgaatcatcatcaatccacccatctaagccatgaagcttaagtcataacccctacccctgacttcaaaatagcctttcagttctactttttagcatttcttctatccattccttcttgtaaattcctggccttatccttttagttaagactctcaactttcctttgggttaatttaacaatctcctagcaactctccttcctttagtcttccatccttcctaaatatcttccaaattattagaaagtattatttctaaatgaacaacaataacaatgaaaaactttgatcatatccccactgctgcttatagcctttcacatctacaacccttctttgccaaaattataagtcaatctaaggacatccaaggttcaggcttggtctgtctctccctaaccaactttaactttaccaggatttctcaaacagtgctggatcttaacccagttattcccagttataccagttacatacctgcaggtttgggcttccttgtttttctttttattgttgtccttgttgttttctttttaaaaattcattgtgtttcttttgcattaactgaaaaatatattttaaaaattaggaataagaaatttaaaaagaaagctgaatgttttatctaatgttttaatatatttcatatcctcttaactttttttctcaggtgactcattaaatatatgctctgtactttaaagaatgagctgtggaggacactccacactatcaggtcttggtcaattagggctgcctctgggagcagtttggagtacaggagatcctgctatctgccaagaagtctgttatcaaaataactgtccaaggcttttccaggccaaaagggaaaaatagtcactgaggttggagaaacaaagtaggcaaataagagttattttaaaagtacttgtcaagcagaaaacacaaagtaggagaagatggagaggaatgacgtaagagtctaataggtgggtgagtgagaggttagaaaaaaaaatcccatggtcttagcacttttactttgatgtttttcatgtatttaaatcaatagagaaattgtcttttaaaactattaaacaggtgctggaagattaacgcatttaacaaacatttacgttgcctacttagaaaagttcaaacataaaatgtaagtcatacacatgggtaaattctaatgcgtacccttaggaatttcttttgtattgttttatctaaatatacaatcaaacaaatacctatgagtgaaaacattttgctacaacttcattcttaatacacaggcaaatatcaagtctttgtgtttgatatacagtgacagtgattgggaagaaagcataaaacttgaatttacatttgctctaaggctaacagtgtaaagcatggtttcttagtgctggaataattggccacttgagaaaattattattctctcactcttactctgcgtagagcaaatggtggttgagatgtagttggagaagtattctttcctcttttcagctgctctagccacatcgccgctcctaggtatgctcaggatgctcacaatccaagcatccctgttctgcttgttatctcttcttcccccgccatctcattactttttttctctttttcttaaatgtaagttttgcataaagaaaaccattttggccctcttgcttttccatctcacaactgaaattcaaaaggacagctgattgtttaggtgactcattgtacagacaatgcagcattcacgattttgcagagcctagaaagggagaaattgcaacgacagtttgttttttttgtttttgattttttttttttacctcaagcaagctgttatattttagacttcacttatcataaaaataacttaaatattcacttcgtatattgcaatgctgtatttttaaaattaaaataacccttacactactgaatagacacctatatgtaatgaatcctcgtttccccaattataaattactgatagcatatcacttgagtttgatggagttgcctaaacacatatactttaatttacatttcagcagaggttcttttatcaaataatctgggagagtttcctctattataaggccattctgctgatgttggagaatcgagttaccacttgttgccagtatgtctttattcctgacctctgcagttgtatctcagaaagaattgtcccactcaatatcatctgtttgtacaaaacagatcattatcaagaaatcattcataatttgaaacagaacatccataattgttgctacaatgttatgcattttgaggaaagtttattaatttgcttgaatttattcattaattgttttgcttttccctctgaaattatgacagtgctcggatttttcatatttctctttccatttctaatggatgcttgtctaaaagtaatttactcaaacatgaaaaaggccatatgtcagtgagcatgattttttccatggtattagggaaactggataatgtttaactcaaaaaatctaaggccaggtcctcattattttatttatatttaagtgctctttttctcatttgtgtgattatgtttacttttactattgatctgcatatctataatacatttctgtaattattacaattagttattctatggactaatattgaggttttcttcttgcattgataaggatagttgatagctaccattttggaaatttcccaagctaaaattatgtacatgctgtatggcatagaaacttgaagatgcaaatgcttacttttcaggttttcaagtgtctagagaactgtattttgagaaatttttattctctcctaatgggtaaagagatggtggcaccttattctcttatgggtctttattagttaatatcagtgttcataatataaacattcccttctgcttcaaataattttcatgtaatatagatctgttcttagtagcactaggctcttaaaaaattataaccttgaattatctgctttacaatacttgtcaaaatttgtactatgtgcaatataattcttagagaattgcacaaaactatgcattgcattcatttctttagttaaaacatgttacctttggttcaagctagattagcagacttgtgcctatgaaaaaaattacttcagtgtaatatgtgcattatttgctaagtgtcaatcatctcttctataaaatggggatattaataaccattttacagggttattgtgatgattgagtgaaacaaattatgtgaaatattaagtacacccccttacagttagctatatttttttcaatacatgcttaccaggtataaaagtgatcagttctgacagacgatagcaaggagttgtcacaaaggaggtaacaactaaatcagaatatgaagggtgagtaggaatttttcagagagcaaaaggcggtaaaggcaattcaggaacagtaggtacaaaggcaaaagggagctagaggctaaagaatggacgggggcctggtatgaagacacttgtagacaaagctgagaagtttaggttttattctggaaatgaatggtatttggtctattcgattttttgtttgcctgttttaactattaactttaaaaataaaataacttctaaaagttaactaaatcctgattgatgggactatgaaaacattaatgcataacaagttttgttttaggcatcaatttaattactaaaagtaggtgcaagcatatcaaagataatcagaagcaatccgttttgccatatggaatgcaaaagatttgaagtgtgcatactcctgaattttgagtaatatttactttgaaaacttaagtttcagttgctcttctgtatataaaattatttaaaccctctaatagcattatttaagggagtctcctataggaaggcaataatcagttactaatttgtatgttttgaaaatgtgtatttgacaatactttgaaaacaaaaaaaactatataaaaatacagtagacccttgaacaacatgggggttaggggcaccaatccactccccacttgctgttgcaaacctgcatctaacttttggctcaccccaaacttaactactaatagcctactgttgaacagaaagtgtaattagaatataaacagttgattaatacattttatatgctacatattatttattatattattacaataaagtaagcaagagaaaataaaatgttactaagaaaatcgtaaaggaagataaaatgtattcactatttattaagtgaaagtggatcatgatgaaggtctttgccctcattgtcttcaggttgagtaagctgaggaggaggagagaaagaagggcttgttctttctgtctcaggggaggcagaggcagaaaaagtggaggaggtgaaaggggaggcaggagaagcaggcacacttggtttaacttttattgaaaaagattcctcaatgtaagtagacccatgcagttcaaaatgcatgttgttcaagggtcaactgtacattttcatatatatttgtcagattttctatttataggctgaatatgatgtaatagggtttttaataatctaaacagataaatactggctgtcattctaccactaatggactgcataaccttaatgtaattattgtccttttctgaacctcgtttcttcatctgaatatactgatatggttccttcctgtgctaagattggagctccagttttgtgattgccattcatttccaaatagaaaaaatttaataaacaaaacatatagatagagaaagaagtgatttagagaaagagaatatgaaattcattgatacgtatgtatcaatatcatatcagtgaacatgatattcactgatacgtaaaagcatttacctaaccatctttaaatggttcagtgtgttcctttaatcttgtctttaacccagattagcatagaactatttttctctcatttgtaaactcagaaatatgaataaatttgttttctgttaataaaccatgcactacattcttggcagtcattaaattaacaaaggtagtaacttaagaactgattaaatatagcttaatatgcaattgtcctttcatgacttggtatacttcagatatttcggtgaaatttttattattgcttaagattttaaaaagtacctctgcaaactatgattagttattgacttaattggtgagcagtcacttttcagcccatatgaaaaatcccccctgtttgtttatgggtttaacatatttttatgattataaacgtgaaacataaatctgtactggttgatgcgacaactgaaatatggcccttcagcttgttcttcttctgtgtcagactttatttaagcatgttctgcagaatgctagtattcctctagatgatccttggaaaataagattctatgaacaaatttttgggaaatgttggattcaacaaagtgaagcaaatagtgttaattttgtttccacatcagtccaccaaaagagtcttatttgagcaacaaactgatttttgtgtgatatttcatgggactagaaggattgcataggacatattttgggaaacacagttatgtttaaaaacaatttacattaaaaacttaaatgaaataaaacaaacaaaaatcatagcacacctggcctctgctactccgagaggaagattgggacctaccgggacagatgtttttctggtaagggagagtctaccttgctataagtatctcgtaagttttactggtagagcactgttcctttattctttaagttataaagtagtaaattcaaattgaagcaaaagtaaaagtgttttctagttaaaaaaaaaaagctagtggaaaataaaattgtagcataactaatagaaattaagttgtagtttttaggtagtttattatatgatggacttgaaaaacagctagtttcaaatcagaataattgcctttttcttatgaagttagtctggagggtgaagactggagattgctttctttctgtgtgaattagttgtttcttttaaagaaacaaaatcaacataaggaaatacctgggagttttcaatacagatgtctccaaaagtattattgctgccatgttattttttcaatgtgtcacataatgtttatataatttataaatgataacaaagcaatcaggccacattcataaaagcccagtgacacatcatttagttgaatctgaggattagaattaattgtctctctttgttccaagttctaaatcttagtaaatgattcactgtatgtcattacagcttaatatttgcatgaaatcacagtttagctggcataatttaacagcaattaaaaagctatttaatcatcatgcaaattggtatgagggcccttgagtaagaagggtgtcagccttcttgtttttttttttttttgtttttttttttagtatctgcaggcggacagttatatacttatagacacccataacataattgataatattcttcctagaatgaaaatataagtgaataataattcctgctttccattataaataagagaaaagaccaaccatatgaatatgtcattctgtcggaaaacattattatgataatgacaatgaatctttatctcctagactaagtctaggttggaggtaaaaagctacgtttatccctgttctctagtgtatcatccccttcatgtttgccttcctgaaggtagacgtttctgtaaaccctatggaatatgaaatggcataaagcaaggcacccagcaaccttttagaaaaaatgattcattgcatttctaggtgatgtacctataggtagctgaggtcccttcctgttgtacatagaaaactatccatactcattccaatgagcctagcagtcctgcactatctagcttcttcctgttccttaaatcttacttcatgcattctccctctgcagtctagccacagtgactttctgccagttccatggttatttcaagatctttctgaacaagaatggcatactttctattcctaatatttttcccacccctctgcatattctcctcaccacctctatgaggctttctcaggaatgttacctaaaacaggggtccacctgattgcttttatttcagcacctgtctttctaatttttgtaattgcaaacattatgatttgaattttattcatccgcttacatagatctagtcactccaccaaaatgtaaataacaagagagaaggaataatgtctaccatgtcttatctctgtaagcccaagaatctagtagagtatctgccacatagtagacactaaataaaatatttaatgaatgaatggccgtagcttgaaatccaaaaggagcctatatcaaaacttgaatttatttctaggagcgaatgctagggagacattgctttccacgctctaagcagagtttcttggtaacagaaattagagaattggtttagattttttttttaaatgaagccttctaaaatatggcgtgactgttgtttcaacagtcatttatatagtatattatttttctaaatatctctcataagtatagcctctcacagcatacggattctgtggtttttcacatatagtacttagcatagtgtctggctcctagaagacattcaggtaatatttgtttaatgaacattataaaactgaggcttaaaggactcagataagtatataggattattcacacaattttaaggaaaggctggagtaattagcggctatcaagcactctacacggtgtgatctttgtggaaaataagaagatgctcatcccctccttagactgacttggttttcgaggtctttatgacaaataggagaatagtgtgggtctcttttaggcccacgcttagtttaaaggacacacctacttgtgtttagtaaacttaatctaaatgaaagtcctgccatcatttcttgtcagtggcccctttttatcccttccatatcatgcttttatcacatcaaattgacaaggacttaataaaaggttttttgttgccttcaattttcatttcgtttttcctttttccaaatcatctgctcaccctaaatttatggtcatttaatctcaacctttgggaaacagatttttagtgattttcggaggtgatgaatggggattttatctacatatgaattatagtatgaagactgaaaaacttacaacaatgtgttttgtatatgtatgttactattttttttcaaattttgaaaatggtgatataattaataagatgtaattaaagccatcacataatttaaaataatttttgttatatattttcagtcaagtttaaaaggtgtaattaccatatgttttacagatatcctgatttttatattaaatattgaaattcatactccaaaaatttatgatatagatcttcattcctcaagactccttccctactagacctaatgagctattttaaccatgtgatcattatagatcccattagaaaaagagttcaaactaacataaaagagcaacaagtgtttattgatgaagttttcattttagcgccataattcattgtcctatatatgtacatttgttttttaattgcttttctctagggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatggtaagttccactgctgttctctcaaaacagacccataatttcttttgatgcataaatatccctcatgggcatgtatttattgcaggtgctatgcagtcatatacgttatacactgcagaggtaatgcactggttgttgttcttgttctttcctaaaactcagaaagatatttttatattacttctcagcagtatgaataataagatgaaatgcttccctccactgtttatgtactcatgtattttgtataatcatataacaatatatcttaatgagtaagtccatattacttaccaatagaagtcagaaatcaataaaatgttattaaatgaattgaatttcaattgccccacttatgctgccatcctttttgcatgtcaaataaagcaaatagtaagaatttttaaaactataattcatgtctatattatgaaagcattccaactaatatatttgtgttccactctaagtagcagaaaaatttagaaatgtgttcaaatgtcatcatctatgtgaagtttgtgaaaagtagttaaactgttcagaaatctgatgaattcagctaaatgttctctttataacatcatagatttttactataatatggtcaggcgcaaacactcctatgatttttacaagtatatactttctttaattccttcataacataattatattgcagaccaggaaacaagaaaagcttcagagatttttaaaactcctttcgagaagtgttcataaattatatgggcacacaagttattgccttatagtaggaaagtattgtaaatgaacacatatatgagcaaaaatttataaagcataaaactatttttatacaccacatttgtttgctaaggcagccataacaaataagacaggctgtgtggcttaagcaacagacaatttattttctcatagctttgcaggctagaagaatcaagttgtcagcattgttgatttcgttctgaggcctgtgtccttggtttgtaggtggccatcttttcccttggtttcacaaggtctgtcctccttatgtctaatctcctaatcttctcttcttataaggacattagtcatattgaattaggacccactcatatgatctcattttaccttaattactctttagagaccccatttctaaatgcaatctcattctgaggtcctaggggttgtgacttcaacatatgaatatgtagaaagacaattcagcataatatacacaatggcagcatatttaaaataaaatacattgatttgaatgtgttgtgataatactcagcaataaaaatgaacaaagtggcactatgcagactgaaaagcctatttcaaaaggatgcattctgtatgattccactcatataatattcttgatataatataattacagatatggaaaacagattagtggttgccagggcttagagatttggaggagggcagtgtggctatgaagtggtaggagggaggactgtgatgatagttgtatatcttgattgtggtgatagttacctgacactacatacgtgataaatggacatgtacatgataaatgtcatgcacacacacacacacaagccctgtagattggaccaatgtcaatttcctagtgttccatgatattatacataaattcactttgctgataatcttcagaaatacctctaataaataaagcaaagccatataatattgtacactcatagtctttgtatttactgtgtaattttcctcttcatttagcatagttccacatcatagaatttgctttatggttattcaaaatagaattcctattttctcttttcttttcctctttcctttagtatcaacaaaatcttgtcaaatatatcttaaatataaagtagatgagagttttctgttcctctctgcttcagcagatgattttgaaggtttttattgcctcaaccttatcaaaaaatacaatctagtacaacgatttttagctacagggaaaaaaatttaatttctgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcttcataactttatatatatatgaaacagcttcaaaattacaataccaatactaacatcaacaatatcattattaaaacagtttaataatttttaaataagaaaaaagtttttcttatttaattcttaaagcaaattaaatttcttatttaattctaatatcccattgatatttgtgttaaatcactgtgtttaaagctatgtttaacagttccctcttggaggctatgtctccaattcaatacagtattcttcatttgatgattctgttgatttttcaaaattgttcttaaagttatttatttgtttattttgagacggagtctcactctgtcgcccaggctggaatgcagtggcactctctccgctcactgcaaactccgcctcccgggttcacgccattctcctgcctcagtctcctgagtagctgggattacaggcgcctgccaccatgcctggctaattttgtgtatttttagtagagacggggtttcaccgtgttagccaggatggtctagatctcctgacctcgtgatctgcccgcctcggcctcccaaagtgctgggattacaggcgtgagccaccgcgcccggccttttaaagttatttttaatcatttataatatttttatattacaaagtaaatttgcaaggcaaaatatattcatagatgtccagtttctaaccttgtagtgtttatcctattgcctttcacccactaagggcaaccattataattatttgttattcttaggtttatccttacagcttttttatgcatttttcttcaccttactttcttcagttaaaaatatattctgaaataactctattctagtgtttatagatagccataattcctttttataacttcataattctctagtggatatagcatagtttttcaaccactctcttattgatgggcatttagattgttacaatctttagaaataaatctccaggaatggtattgtaaatatgtcactttgtgttgtgcagtgtatctctgagagagattccaaaaagccaaagtataaataaatacataatttttgccttaaatctttaagcttcccttcataagagttgtatcattttgcattaccaccaacaatgtggtaaagtattttatcctacagcctagccaacagtgtcttaccaaatttttgtactttttttgtgccaatctgttacgtgagaaatggcgtatcaatgtgttttaatttggattttattttttctgaatgattgttgacttttatgtcaaaaactgctgtttttttagaaattagaatacttaaaaagtattttctaaaaggtgcaaagagaagaatctgagagatatatagtttagttatatgttagaagcttaacacagattattttaatttagaattataatatatggaaaagtaaaatagacatgattctgaaaataacttctaaagttaaatattttaactttgtttaatgtcacagaaactatgcaaaagaaataatcctcacattcataaacaatcatttattgcagttataaagcttataatataaacttttttgaagccttaaaatgtctagaggaaagggagaagcctataaatgatcttgtaattgcagagtttgttttttcctacagtagatcaatatttgataaaacatacgagccaagtgtattgtatttcatgttatagctcaagaccaaaaccattttaaagaaaaatatcctcccctaataataccaaagatgatgagttctggcccttactcttggaatatttgagtttttcctgtgttccctaagagtgttcctaaatatatttaatgccttatttggatcgaatagagcatatcgtaaggctatcttattaatctgccttcaataaatggtgtcctcttcaacaagaattttattttccttggaagagaaaatattaaagaaaggataatggaaaatgattcctgccaattaattcttagttattttctttcctttcagcaccttccctgataggtgtggtaaggaaggactgggcatcccaaaatagcattgccctatcatggcaagcacctgctttttccaatggagccattctggactacgagatcaagtactatgagaaagtaggtcttatttggagcttcctataaaactacatatatatgcatatatatgtatatattgagcatgtcgttatactatattattttattttaaaccctgttcttctttggcctagcctcataccttctgtttctttgaatcctctctaacttactattctgcttgtaagttattgattaatttatcttgttttgtgtcagattaaagtagaagatgtaagatgttcatttctgtcatgacctactctagagagttttataatattgtaagaagaagtaacttcttcaatttattcaatttatagtttggttgctaattgtttctaaaattcagatgggaagaaattttaatattgaattactataacctgaagtgggtttttgtagcacatatcctttgccagtgtgtttagagttacagtcggctataatttggaaagtattatttaagggataaatagaaatagcatataaatgaaacactttctttacattcaggttagctattttattttataagctagcaagataaattcagttgacaaatccttatttataataatggaacccttatttccatttttgtcatacattagtatatttccccattatatactttattccctttattatatttatgttctttatgcatttttctctcattcctcaccattatgatattcttggcatcaatattacagcagaccacatagtcaattctgaagtgtcttattgtcttaatactacttctagaagtatgcaaagggaatgttaaataaaaattttaatgtaaaaattatatgtaatatccagtggtatattacaatgagaaggaacatcttgcatttctgtcccttactagaagcaaaggaaatcataaaggaatttagtcttcctctgaagaaatagagggcaagaggagaaatagaactctactttcttagtttattttgtctgctgtaacagaataccacagatggagtaatttataataaacagaaatttattggcttatggttctggagacgaagaagtctgagatcgaggacccagcatctggaaaggaacttcttggttattgatctcattgtgggagggcaaggccagggtgagagagaagcaaaaggaagtcaaactcatccttttattaggagcttacttctgcaatatgaaacccactcccatggtgacaccaatcccgcaaatgaagccatagtcttcatggcctaatcacctcttaaaggttccatctcttgattctgttataatggcaatcaaattaaaacataagcttggcagggacattaaccataacacataccttcctctattctactgcttcagagttaatctaggtttgataatgggagaggtaacttagtagcatagctgtatccattttttgttgctctaataatttcagcattatgtagtcaataaaaactgtcattatctttaagtgacatagataaatccatagcctaagaaaggacaaatttactgagtttaaattggaatacagattctgcaaattatcctggccaatatgtgctcagaaatctgctgggctagcctttcaaatgttacagcctatagcacactatcacaagaaagcatatgttttctgttgactggtttaaatatattttcatacactcaaaatttctgactatttaacaagcaatgtgcatatatatacaagcaacttttcagaatcaaaatatttctctgtgttttataaggggtatattttacacatagaaaaatcactgtctaattttatagtcatttatacctgatatgtttgaggatgaaaatgacttgcaatatttctaagttaggataaatcatacagatgtaatagaaagagaaccacattcatccaatcaaaattttataaattaatatgattctaaaaggacctagaaagatctagatctaggtaatcttttacagttctagctattgtcaaatgctaatgtttgtgtatgtactgttatatagataaattatcttaatgttatcctatccctctgataactatggtttttcattgaaatctactgaaattaaacacacacacacacacacacacacacacctttttaaaatacctcaccatagagagcagtattcttaacatcataattatatgtaaaaattaagaccctagcattattctctttctctgtgtgtgtgatgtgtctgagtgtgtttgtgtgtgtgtgtgtgtgtattaagagtgatatgtcagaaagaaaacatattgctttatgggttataattagttagatattccttattcagttaattacattccctaatttttagtcacttttctttttcatactcagtctttcattctcctttaactcaagtgaatacagcttgactatgaaaggcactttaaaataatatgggaagtcaagaaaagttacaaaactttttattttttttatttttttattcacttactaatactgcttttctccaataggctctccagtagagcccattcttataatgagggaactaagacatcatctgctcccaacttctcagtcctccccttcaaaacagtccaaacccgcttctattcatatcgaagagcaagtataccctttgtctttgtttgttttgtgatgctataacataatatctgagactgggtaatttataagaaacataaatttatttctcacagttctagaggctgggaagatcaaggtgccaataggtttggtgtctggtgagggccccctcctcatttctaacatggctccttgaatgccatatcctccacagaggagaaatgctattcctcacccaacagaagaggagaaaagcaaagagaggggaaggagagggccatacttgccttttcataaagcaccaatcccacccaagagggtgtagccttcatggcctaatgatctcttaagggttccacctattaatactgttacaatgacaattaaatttcaaaatgaggccgggcacggtggctcatgcctgtaatcctagcactttgggaggacattccaaccatagcacccttctcttatctctgttcccttctgtccttaccctttgtgttcacattcttaatttttcttcctgtgccctcttttctcttctcctccctacttttccctctttcctctcctttttttctctgcccaagcaaggcacacttccttctcttgcttctttgttatttcattattctcttagtctgtttcggctatgtgataaaaactaataaactatgtggcttataaacaatagacatttatttcccatagttttggaaagcaggaagttcaaggccaaggctccagaagctttggcattgggtgaggtccttttcaggttcatagacagtggttttctcactgtgtcctcacatggcagaagggtatgggagttctctggggtctctttcataagggcaataattccattcatgagggctccacccctgatcacctaatcacctaatcacctcccaaagacctcacctcctaataccatggccttggaggtgatttcaacatatgaattttggaaggacataaacattcagactctaacagttatatttaccaaaattagtcctaatcagagttatttatttgtggatctggacttcccccagtagtttatgagtccctgaagaaaagaattgatttcaaccctcaatccttgcctaacacagctatttcctttcaataacattctagctgaattagtaaaattctctctttgttcagaactcattcccaggaaattaagaaatgatgcagccactgtaaaattacctctaacaagttttttaaaggcagaaaagaaacaaagaaagccagcaagactttctgtttctacctgttcataagaaagacctatacacatatgtccatcagctgagagaacattctgttaaggacaagaatgtaagctcttgagggcaaggatttactttgttcactttcttatccttagtgctcagagaggcccatagatggtaattaatagatactgattgttgaccaactatatgccaggtaatcttttaagtgttttgcaaggactagctaatttactcctaacaacatatgtttgaggaaaatgttattattcttcccattttacagattaagaaactaaggcacaaaaaggttaagtatctttaccaaaatcacacagccagtaagtgggtgttaaaactggccatcataccttacatcacagcagatgtctcagaaagtcagtgctttctgctgatgctgattttctaggttccctgaggacaaacacttcattactctctcatgtcaattttgcatctgcaaaatggcaggaataaaacatacctatctcaccagggtattgtacagctcccctaattatcaactggtagctcattttgcaaacatgaatcccctcataacagttcattattctcacatccagtattttaagacactgtgactgttaaagtctttttctcaaagtggtcttgttaatttttatcacagtcagcagtttttagattttaagaaaactcatcatgaaaaaggtagcatttcttatatccagatgttcaataattatttatatgaaatgatgaattaatataacctgccagtgtttcacctagttcacagattatagaaaaactatctttgctttttaattaaaaataaataatgttgtgacactgaggacagtgtattatttaaaaaatataaggagatttgtggaaagcttttcattatgggaaatatttttatcaatcagggatgatttaaagtagcctcttttaaaagaaggttgaagtcttagtgtcttttctgaaagtcgcatactcctcaatatcacactttgcacaataagtcttttttcttcctccgtaatcctgttattctactttctcaatatagtttttccacagataacaacctaataattatccctcatttttctaaagatagataatcagtaacatgcatctttgtttaaaaatacatgaagcaattattgtagcaataatcaacatgagaaagaaaaacaatctttccttcttatatgctgctcaatatacatttctcattttcttttgttgtatttcctttacttaagtgtttgcccaagggaggaagagaattttatctttacttccaggaaagctactcttacctccatctgttatttaggtacagaaacacatctttgttctctgcctgtccctttccctgtgaccatctaattcatacatttgtaaaccttaatgtaaactatcatacaaagttaaatgtcgttattacacaaggaactaagaaaagtgtgactgaggaaagtgtatatggatcacatggggatcttgctgaaatgcagattgtaatatatttgattgggcgaatgagtagtgttagtggtggtaacatgagattttgggttcctagcaaactcctatgtgattccagcattcctctgagttgtcagtctctagaagccctacttttccttcacctcatttaatcgagtgttgataaaggggaaaataatcacaatgctctcaacatagacgtgaacttacatgctatgtctctataactggctagcatctctgtagattttacatgatttgtagatgttgttgatctgtaggtgttacatgacatcagaactacaagtattaatctgaagcaaaatgcagtaaaggaccaagtcaattttggatacaattcagtgtttacagtggaatcagcaagtttttttttttttcataattatttgttgcagtgtccaccacagagaaattagatgtgagcatttggtactaattaaaacagcattacctgaaagaaaatggacagcaagggaatttactgatacaaacactcataaaggttttatatccaatttccatgttgttcaataaacatcacattctctgtggaagcttgtctggcttagtaagcccagggaggaccatagtgcctggagcagagattctcatggtagcaagactctgactggggccaatactgcatccacagcagcatctgtatggtatacccttatcaaacaggaagaaactaaaaatatattgacagcaacattgcagagtctgcaaacacatgaaaattacaaatatctgctaactatacctctaaagtgtctcctgttttataaaagttattctatctttggtttggtttgaagaatgtatttgtttaaaattatagaagctgcatttagtgtattaaagatttgtatatccaagaaagaaaaaaatagttggtaaaactaaggaccctgaataaacttcatttacacttttgaatatgctataggggaaaagaaacatctttcttttctatctctaggctcatgactgaggtccttataaaaacgaattaagaagagacaagcctacaaatttacttaatgtgagttttacataggccaggagccttcagatataaagacccaaagaaacagagaaacctatgtatttttatgcttagatttgaacaaaagtggacagttgcacggaagtgtgattaagcaaagggatatgatccagtggtaataaactcagggggagtcgcttaacaagacctactgttcagattattttttatatatttgtgtctttatagataaggatgttctttcctctgggcatagggacagcacctctcaaatgaggggctcttgacctgatttcagaggaggagggcaggagaaagtcaaagggtgatctttctacttttgccgtttgctcaaattccatggtgccatatttggggatagaatgttttgaaccccatcaatatctaaatttatagactgaaataaaggttatgactatcaaaagtttatgttctggttacaagaaaacaaaactctctttcctactgctcagagggctggaattcttttggtggtatggagtcatattgtagaatttcagtcccagcctgatcttgtgtacaactaggtaaggctacataattaatcccacttctgctaaattgctatatttcagtcaggcccaagttacacctttaaattcagtttcacattctaacctcatattcagttgcttccatattcctagtcatacatttctgaatttgcttcctcaccacttttcctgaattccatgtctttatctctttttcgatgaggttggaataaataatctaagttgttatccaattctgaacttccatgactgcagaagcttatttttcattttgttatgctttgctatacaaggtgatagaaaaaatcaaataagactaaggaatgaatgagacatttgatgttttcagtgaaaatattatgtatacgtatatataaattaaaaatgacagagaagtacataaaaagataaggatgaaacagtaattcaatttcctcagcaatctggaaatctacatatactatcaagttttgcatttgtaagaaaagagaaaaaatataaagctatttttaaatgattattttcttctaaaaaatgtccactttctgttaaagaaactgtactgtttggaggaaagaaaataatacaatgtgggatatacttggggagtccagaggttatgttatctgcaatggtaaattatcagagatcacaatgtcccttttaagcatttgggctaatacccaccaagaatcagtgtagcttgggattattagtatttttcttttctttgcttttcttttttttaagaaaatgccttctggggagtaacaaggacataaattcaaaattcctctaaatttctgttgtagtttggtgaaaatcaaagaaacaaaactcacagacaccacttttaaaaaatgtagcattgccatgaattcaaagtgcagtcagccttcaaaaaactactcttccagcaaagaaaaatgtaaatataatgttcctacttttgaaagcctgtaaaccaaaaagtgactgaagcaggtctcaactgatagaggtttattttgccaaggttgaggatgcgcctgaggaaaaaagtacagccattggagcatctgtgacctgagttttttccaaagggggttttgggaacttaagtatttacaggggaaagagcaagcaggagggagaaaaggggaaggagggtaggaagtgaggcagatcgttacattcgtgtgaggctctgattagccccaatgaatctacattttatgtgtgaaaacagggagtaaaggaaaaagtcaattttacattgccttggttagtaaatctacattttacataagataaactaagcctttgaaaagtgagtgcaatggaaatgaggctatgatacaaggttgtgaaattacagttctctgtctgggaactaaaggaaagcagtttttgcatggctcagttcccaagctttactttccctttggcacggtgagtttggggtcctgagattatattttctttcacaagccaaaagtacaaggcaggcacctaatttactatccccaaatgatgaaggactaaatacctaaatacctaaagataaatcttactagtttttaaatataaatttcaagataagagctgcaactagattatgttatctaacccttagcaagtttttccttgataactggccttaccaaagagttgaccgagtcatattccctggagacaaatgcaagatttgttcatttcagatgcaattaaaaatgctaccatatttgtgtctattccttaaacaatcattatttggggctacaagtacaaacatacttaccaaatcatacatttacttttttgcttctgatacttctgatactctactgctactcccttcaatctgaaaatcttaataagaaaatctatataaaataatggtctgatatagggttgagttttgaaataggaaaattaaattgagaaaggccatttcccaataattttttatatagatttgtattacttaatatattcaaataaatatcttaataaaggcatggctaaacactgaggcattcccctgcttcaaccaattctcccaactctgatatttggctcatcttttctaattgttaatcagtacacctctttagaaaggaatttcttttagaaaatgccttactttcttaatttagataggtacttaacaccctcaagaaatgcatcaaacctttaaaatttagagaaaaaataattactacaaaagtgctctgatacttaaactattacaacgaaactgttttagtttattcccgcatagtaaccgatgtatagtaagctgcttcatttcccggctctgctattattatcctcattcctcaagggtagacttaagtgtcttagattctcaaatgaaagggaaaaaaacctaagtctgtattctgcttcaaataactagaaataattatgaggcttctttgaccagatataatttttgccttggagagtaaagcaaagccccttgcaacagccattattaatgacactgatataattactatttgaaaaaaggaaatctgcccagaaaaatcaattgtaaaccaccaaatgttccttggacttttcagagagattctatgcctattgtccctcatgacctctccattaagagactggttggctatattcctaatggttgccttcaattatttagagaggacttctaagcttttgtatttcatattaaaatggcctggagagcattttctgattgacttacttgcagaacagaagggtcactctggggaaaacagagtaacctaggtggctttgctcgaaaaaggtaactcagagtcctcttccattagggcagtttatcatgcaaacattgattctcatacaatgaagcaaacagtgtatgatgactttgctttcactgaaaaattacagaaaaaaaaagaatagttgaaagagtcattaggagtagttatctgtaatctaaagcgagcttgatttgtgcatctgcatttatcacctcttttgtttttaacttgccacattctacttctcttaacattattctcaacattagtggatgagcgtcctcttataatcatgcaatattaattagtctccagttgtaagagatgtattggtttgtaattctgtcttatctattcattggacaccttgaagctggtaaaattttctaaaagatatagttgaaggcaaaattagaaatgaagacagactttataaaatggcagagaatatcccaggcaagatacatgttgagatgagggtatgaatttgtgaaaggacaaaacaaactcaaactggtcctgtgtaatggtcaaaaacttgaccatatatatcctttgatttaaaaatactaccagttttttacagtctgtatcagaagagcttgttaaagcacttgtctttgaattcaggcatctgtttgaagcagatcacaaaatggacatttcaaatcacaattcatgaaccgtgtctgatttctattcctttgataaattaaatgatcagtaacaaaatatctgtaacacattaagctccctgaaaaaattactccagtgaattaaaactcaacaatatgcctgcattctgcattcagaaacattggttgaatttgtttgttgatttagtcaatcgtcttttaaaaagcacttgaatttttttttacttgagttttgcttcagaaaaaaatctaattttgtaattatggagttatattgtttgttgtcaaaataaatgtttctccatttcgcctaattgtcagaattttttggaccaatttttagcccaagtattataatctgtggcatataaaaatctaaaacacctacttgtttttattattacaaatctacacttcaccttgtactaatattttgttttaatatagaaaaaaagtagaaagaataaaaggaaagaaagagaagaaaccaaaatgagttaaatacccctatgttccagctcctgagctacatatttttgtgtcaacctgacagcagatccagaattatttccttcacaccatgctgtttcctaaaaattaaatccaagactttttggcaatctaaagttatattagaatttagagttaaatgaaatgctatgataaaaatcctttgtggataaaattttaaataattaaagagatgaaacattttcatttttggattaggcactaacctaagatggagaggtatttaatattaataactgtgacaaaatgagaagataagaagattctaggtaaagggaacataagtgtgaaagtccaaggtaaggaacttggcaagttgaaggaagagacagtgttctgtggcttgaatatagtaaggaaggagagatgagcctgaaacagtgagcagaggaaagcaaagtacaccatttctctcctctttcccacatttaacaaatatttattgcacacctacatgtgtaatgtttagcactacagattcacattaggaatgatattaaaatttttaaacagtatcatatttgtttaaatatgcttaagatataattaactcattgaaaatttattttctttcatgattatgagtatctttatatctttcatcaatatcattttaactttcagttatttttccccaatccatcattcaggaaactaatctagaaaaattgagtattttatacctctcattctcttctttcccttttttaaaggctcagatcaaggtaaggcatttacaaatgtctttaacatatttataatcataaaataatacatttgattcataagttttatttctcaaaatattagtttggaatgaatccaaaacaaaatataacaccatttcaaaagttaaaatattccagtcagcatatgtccttgatgaaatgtatttcttaaaacaattatactcctgatatgtctttcatttcatttaaacatatatgtcatttgctaagtaaatatttttcagggacaaaagagaattgcaagtgactgtacacctttctctgaccatgtttgtctctccatgttgggttctaagtcctgttgggaatatatctgatgtatctttggcctccctggagaaaagcgcttttcctgacacactgtaatcattcaataaaaattagggaataaatgattgtatgaatgaacgatttcttactcctgaactcctactttttctttttttaatggaaaaaaaagtgctatgtccaatagcctaactagaaagtgacttattggcttttataataatgccagagtaggcattttgcaaggctctttctttacaaagtaggtaggtatgtgtaaagcatactcttgatggtaattttgtttttacaaaacttaagggagaatttcaaggacttgccttctcttgtccaaaaaaaaaatctgagcttggaggggaaagatggctgtcagtctggtgtagtgagttttctctgagagcaaatttcaaagtgctctgagaacactattgtcaggatcagagtcttgggccactggctaggagggagaattgattctgcgactttggtgctgagctaaggtactgaaggaaaactgaagtagtaccattctagcagcatacactgatttcttatagacatagaagtaaatcctatctagagaaaagctctcaaaatataagactcagacaccacagattatgatcaggcaataataacacaatcaaagactaccaattacagaaaaaaacaaaacatgagtgaatgaggagaaacgatctgcaacagatttagtatcccaaggacttttgatgcgttaaagaatcatacacaaaacaactatgtttgaaaagtttaaaaaataataaatgcaatcaggagattgagaaaaagataagaagaataagcagattgggggaaattaaacttataaaattaaatatataattataagaaaaaactcaataaatagatacacagtcatacactatatatattaatatttatcagtatatactaataaatgatactaataattactaatgaaaagacatttaaaaaatctaacaatactggacttcattctaagaaaaagaaaacagaacagagagcatacaatacttatatgaataatggttgtgaattttctagaaggaagtataacatgttcaaaataggaaaaataacacatatctagaaactttattacagctgcatagtataaaggggatagagaaaggggacattttaaaaattaggcatatagaagaaatcactgacaaaaaaacatgacaaccagacttaaagcagctgtcttaccacaatagaaagtagacagttgaaaatagtaccctcacatttttcaacccagaatgatatatgccaaactattttttcaagaataagggtaaaatattggtgtttagagataaacaaaaagagggagtttgtcactcaaagacctaccataaagaaatgggcataaataagaaggaaaatgattccaaaacgatagtataagaagcaagatgtgaataaataaaatagtaaacatgtacataaatctgaaaaaatacatgtataaaatagtatctttcaaaagaaataaatacaagataaaatagcatgcatgaatcaaagaataagttgtaaaggaaattcaagtacttctaattaaatgataatgaaaatattacatagcatagagtgtggcatccagtatatgcaggtaataaatgaacgagtataataaatgcccttattggaaagtaatgaagtcaaaaaattaatgaactaagtatcttacttaagaatttaacagggccaggcactgtggctcacgcctgtaatcccagcactttggcaagccaaggcgggcgaatcacctgagttcgggagtttaacacctgcctgaccagtatggagaaaccccgtctctactaaaaatacaaaattgcggggcatggtggcatgtacctgtaatcccagctactcaggaggctgaggcaggagaatcgcctgaacccaggaggtggaagttgcggtgagccgagatcctgccattgcactctagcctgggcaacaagagcaaaactccatcacaaaaaacaaacaaacaaacaaacaaacaaaacagaaggggtcaggcacggtggcttacgtctgtaatcccagcactttgggaggccgaggtgggtggatcacctgaggccagcagttcaagaccagcctggccaacatagtggaaaccccttctctactgaaaatacaaaaatcagcctggtgtggtggcaggcacctgtaatcccagctacttgggagtctgaggcaggagaatcgcttgaacctgggaggcggaggttgcagtgaggtgagatcttgccactacaatccagcctgtgtgacagagtgagactccctctcacacacacacacacacacaagaatttaacagaaggaatataaaacagtaagtccagggaaagtaggaggaaagaaatcattaccacaagagcaaaagtgagaaaataaaaaaacaaagacaaaatagagaaaatcaacaaaaccaaaaattgaaaaaactgattgattacataaacctttagaaagattgatcaaaatttaggtttctaaattcaagaaagaagacacttagatgactgaagtaattcaagtttctaaaggctgagaaactgggaagccgctagaaatcaacacatgaaataaccaaaatgaagacaagaaacttctgtgtacattaaagtaaaaaatgggttgtattaccaaaaaaaacctgatttttagaatacagaggaaaaggaaaggaaaagccttctgaaaaatgtcttttttgttaactttacatgcatttttcatgggtcaattgatcaacactaaatattaagtttgagaatcatttgtttatttgtgtattcattcactgcatgtgatagatctatgtgccaatctgggtattataaacatccataaatctctcatatatcatacttcaagttataataatgtcactcgttctctgtgaaccctttgatacatcattccattcaataaactgtttatcctttgattcttaaaaaaaaaaagataaaaattgaccaaaataaaagaaacaagaaactaaaaactgggaagaaaaatgaagatatagtaacaaatattatagagattggaaatataatgaattttccaagatcaaatttatgtaaattacatgtgaaaacttacacaaactagaaaaaacttcatacatatattatttactaaatatgactaaaaaggaaatagaaaacttgcataattacttcactactaaataattggaatcagtggataaaaactgttcccaacactaagagcatctggcttagatggtttttaagtcatttttttcccccatctttcaaggaacccatcatttcaaacatattcaagcttttcctaagaatggggaaaaaaggaattttctgaagtgtgttccataaggccagaataacctcttaactgaacgagggcagtaggagaaataataactacaggtaaatcttactcagaagcataggtacaaaatcctaaattaaatgtaaccaaccaaaccagctaagtatagaaaaaaagacaaacagacaaaaaaaaaaaatagggccaaatttggatttatttcaggaatgcatgagtattttaacagtagataatttatcaatgtaacttaacattcagcagataaaaggaaaagttccaaataatcaccttaatagatgcagaaaaggcatttcatgtataccatctattcttgggtattattctcagaaatctagtaatatgagataacttctttaacataattcagatcaagcaaatagccgtcttagtgaggaaatattacactacttctcccaaaacaagaactacataaaaatgtccattatcaatagtttctactaaatattagaggatctcgccattccaatgggataaaaataaaataaaataaaagcatatatgttgttaaaaaaaccccacattattccagatgatatgactctttacataaaaatttttcccgaatgtacattcagatttaaaaagattatagtaaggtgtctcgctctgcaaatttaaatgcatttctatacgtcagcatcaaaagaaaacacattttaaagaagttaaatttacaatagcaacttaatctgtaaagcatttgagaataaatctgaaatagttttcaatatgtacaaaacaataataaaattttatagaaagacattaaaaacactcaaatacagcccacatttgtaaataagaaaagcttatcatagaaagatcaattttaccccaaatgatgtgcagctttaatgtctaataaaaattctagcagatctctttgtggaaatcaaaaaactgattttaaacttgatgaggaaatgaaaaatagggggccatgaataaccaggatacttttgacacaaaatatgttgaagttacatgccttggcagatactttagagttactgtatagtgcataacattgttgcacaatgagacagcaagaccaatgtattgtaacagaatgttcagaaacagacttgcacatgtgtggaccttgaacctatggcagaagtggcactgcagatcattaaaaatgtatgggctattcactaggtaataggtactgggtaatgtatattggtagaaaaaaaaagaaactagattcccacctcatatcattcacaaatttaaatccaagtgttctaaggacaaaatgtgatggaaagaactttaaaatttttggaaggaaaatagagaacaatttcctttctccttgcaaggaaaatatttcacaaatgaaatgcatattcttaccttaaaagaaaaattgataattttcattatagtcattttaagaatagtctctcaaaaaaaaaaaaaaaaaaagaatagtctctcaaaaaactttatttagattgtcaaaagacaagacaaactgggagaagatatttgccatgcatacaattagtaaaggagtagtatccaaaatacataaagaaatcctgtaaaactattagaaaaagaacaacaagccaattgaaaaccttatgtaagatctgtatgtcaacctaggtaagaaaatacactcaacttcattagtaatagggaaactgcaattcaacaagaatacttaagtatcaaaatatatacacccccaacactggagtacccagattcataaaacaggtttttagagacctctgaagagacttagataatcacataatagtgggagatttcagtattagactgatcattgaaatagaaaacttgcaaagatgtttgagacgtaaaatcagcacttgacgaaatggacctaacaggtatctacagagcatccactgaacaacatacattattctcagctgtacatagcacatactctaaaatcaaccagaagttcagccataaagcaattctcaacaaattacaaaatcaaaaaagaaaactcagtcatatatccctgatgaacatagatgcaaaattccacaacaaaacattagcagagcaaacaagtaccacatcaaataactaatccaccatgatccattaggctttattcatgggatgcaaggttggttcaacatacacaaatcaatgtgattcagtaaataaaactaaaaacaaaaaccacatgatcatctcagtaggtgcagaaaaggctttcagtaaaattcaacatcacttcaagttaaagacactcaacaaacaaggcattgaaggaacatacctgaaaataataagtgtcatctatgacaaaaccacagccaacatcacagtgaatgggcaaaagctggaagcctttcccttgagaaccggaacaagacaaggatgcctactctaaccatgcctatccaaaatactactggaagtagcagctagagtaatcaggcaagaggaagaaatgaaaggcattcaaataaaaagagaggaagaaaaactatctctcttcacagatgatacaattttatagccagaaaaccccataatctttgcccaaaagctcctagatctgataaaaaatttcaacaactttcagtatacaaaatcaatgtgaaaaattggtagcatttttatacatgaacattgtccaagatgagagtcaaatcaagaatacaattccatttacaaatgccactaaaagaataaaatacctaagaatacatctagccagggaggtgaaagatctctacaatgataaatataaaacgctgctcaaaaaaattacagacaacacatacaaatggaaaaactattcatgtacaggatagaaagaattcttattattaaaattgccatactacccaaagcaatctacatattcaatgctattcctatcaatctacctatgacattttttacagaattagaaaaaacctttctaaaattcatatggaaccaaaaaagagaccaaatagccatagctattctaatcctaagaaaaaagaacaaagctggaggcatcacattacctgacttcaaactatactataaggctacaataaccaaaacagcatggtacagaaacagatacctagactaatgcaacaggttagagaacccagaaataaagcctcacacctatggccatctgatcttctacaaagtcaacaaaaacaagtgatggggaaaggactctctattcaatcaatgatgcagaaataactggttagtcatatgcagaagattgaaaccggccctcttctctattagtctcttctcaggctgctaataaacacatacttgagactgggtaatttataaaggaaagaggtttaatggactcacagtcccacatggctggtgaggcctcacaatcatggtggaaggcgaatgaggagcaaagttatgtcttacatggcagcaggcaagagcaagtttgtgcataggaactctcatttataaaaccatcagatctcctgagacttgttcagtaccatgagaacagtatggggaaactgtccccatgattaaattaactccacctggccccgtctttgacacatggggattattacatgttaaggtgagattttggtggggacacagccaaaccatatcttttcacccctggccattcccaaatctcatatccacacataacaaaatcaatcatgccttccctacagtcccccaaatcttaactcattttagcattaactcaaacgataatgatcatagtccaaagtcttagctgagacaaggcaagtcccttctgcctatgagcgtgaaaaatcaaaagcaaattagtggccatgcttggtggtcatgcctgtaatcccagcattttggaaggccaaggcgggcagattacctgaggtcaggagatcaagaccagcctggccaacatagtgaaaccccatctctactaaaaatacaaaaaaattagccaggcattgtggtgggcacctgtaatcccagctacttgggaggctgaggcaggagaatcacttgaacccaggaggcagaggttgcagtgagccgagaccacgccattgcactccagcttgggcaataagaatgaaactctgtctcaaaaaaaaaaaaaaaaaaagcaagttagttacttcctagatacaatgggagtacaagtgttgggtaaatacacctgttccacatgggagaaattggacaaaatgaagaggctataggccaatgcaagtccaaaatcaaacaagtcagtaattaaattttaaagctcccaaagaatctcctttgactccatgtctcatatccaggttatactgatgcaagaggtgggctcccatggccttaggctgccctacccctgtggctttgcagggtacagccccctcctggctgctatcacaggctggcgttgagtgtgtgtgacttttccaggtgcatgatgcaagctgtccgtggatctgccgttcgggtctggaggacagcggccctcttctcacagctccactaggcagtaccccactggggactctgtgtgggggctccaaccccacattttgcttccacattgccctagcagaggttcttcatgaaggcttcatccctgcagcacagctctgcctggacatccaggtgtttccatataccctctgaaatataggcggaggctcccaaacctctgtgcacctgcaggctcaacactatgtgaaagcttctaaagtttggggcttgcacccccacaaagccacaacccgagcttgtacattggtcccttttagccatggctggagtggctgggatgcagggcaccaagtccctaggctgtgcacagcagaggggccctgggcccagccatgaaaacattcttttctcctaggcctctgggcctgtgatgagagggactgccgggaagatctctgacatggcctggagacattttccccattgtcttggtgattaacattgggctgttcattacttatgcaaatttctgcaggaggcttgacttccttcccagaaaattgttttttcttttctattgcattgtcaggctgcaaattttccaaactgttatgctctgcttcctcttgaacactttactgcttagaaatttcttctaccagatactctaaatcatctctctcaagttcagagctccacagatctctagggcaggggcaaaatgcctccagtttctttgtacagcaagagtgacttttactccagtttccaagaagttcctcatctccatctgagaccacttcagcctggactttattgtccacatcaccatacattttgatcaaagccattcaacaaacctctaggaagttccaaactttcccaaatcttcctgtcttctgagccctctaaactttccaacctctgcctgttacccagttccaaagttgcttccacattttcgagtatctttacaccatcaccccactaccccataccaatttactgtattagtctattcacatgctgctaataaacacatagccaagactgggtaacttataaaggaaacttattaactcacagttccatatagctggggaggcctcacaatcatggtggaaggcaaaggagaaccaaatgtatgtcttacacagcagcaggcaagagcaagcatgtgcaggggaactcccatttatgtaaccatcaaatctcacgaggctaattcactaccacaagaacagtatgggggaaccacccccataattcaattatttccacctggccctgtcattgacatgtggggactattactattcaaggtgaggtttgggtggggacacagccaaaccatgtcaccttctttataccatatacaaaaataaactcaagatgaattaaagacttaaatataaaaccaaaaactataacattcctagaagaaaacctaggaaataccactctggacatacaccctggcaaagattttatgaggaagcctccaatagcaattgcaacaaaaacattgtcaagtggaacatgattaaactaaagagctcctgccaaccaaaagaaactatcaacagagtaactagacaacctacagaatgggagaatatatttgcaaactgtgcatccaacaaaggtctaatatctagaatctataaggaacttacacaaattaacaggcgaaaggcagcctcattaaaaaatgagcaaaggacatgaacagatacttcttaaaagaagacatacacatggccaaaattatataaaataagtcatcatcactaatctttgggagaaatgcaaatcaaagccaaaatgagatactatctcacaccagtcagaatggttattattaaaaagacaaaaaatagcagatactagcgaggttgcagagaaaaaggaacacttatgcactgttggtgggagtataattaaattagttacacctgtggaaagcactgtggcgattcctcaaagagctaaaaacaactaccatttgacccaacaatcccattattgggtatatacccaaaggaatatatgtcattctactataaagacacatgcttgcttatgttcactgcagaaccattcacaacagcaaagtcatagaatcaatctaaatgaccattaatggtagagtcagtaaaaaattatcatacatatacaccatggaataccatgcagccataaaaaagaatgagatcatggcctttccaggaacatggttgcaactggaggccatcatcctttgcaaactaatgcaggaacagaaaaccaaatattgcatgttctcacttataagtgggagctaaatgatgagaacacatggacacatagaggaataacagacactggggcctactggagggtgaagagtgggaggaggaagagggccaggaaaagtgactaatgggtactaggcttaatacttcagtgattaaataatctgtacaacaaaccccatgacacaggtttacctgtgtaacaaaactgcacatgtatccttaaagtaaaattaaaaaaaaaatgtggtacatatacaccatggaatatgatgcagccattaaaaaaaacaacaaaaccatgtcctttgcagcaacaggggtggaactcaagggcattatcctaagccaattaatacaggaggagaaaaccaaatactgcacgttctcacttataagtggtagttaaatgttgactatgcatgacacaaggaagggaacaatagacactggggcctacttgagggttgagggtggggacggtgctgtctatggggcactatgctgattacctgggtgataaaataatctataccccaaatccctgcaacacacaatttatgtaacaaacctgcacatgtatttcctgaacctaaaataaaagttggacagaaaaaaatatatgaatagtgtatattagtgaaatgaatgaacagttggtattgccccaaaatggtaagctttagaaatataatttagtcccagaagactacatataatataaaaatatttgtagaaacctcaaaaacatacgaaactaaacaatatattatttatgtagctttaaggatgtgctaactttttatttttataagtaaggaaatgataaacaaaattcatgatagtaaatatctctttgaaagagggaggagactggatagggaaggaacacagaaatacaagttaaggaaactattaaattactatattaatgtacaatattgcttatgatatttcagaatttatatcactttagtatattttaaactaatatttcatgaagcttatatcatggatctagtctcactagatgttttaccactatagttacatggtcaaattgatttggaaaatgtagaatatatttttatttctagagtttcacagatcacatgggcatattaaatgctcagagaaaacctaaactaagcaacctacatattttatttaactgggtgttttccaaatacattttccctcagtggcgacgaggagagtgttctccctttaagagagagaacgggctacaaggagggtctccagctaccacagcttcaaggattacctgaaggttcacctgaaagccctcattctgcctgagatccgggtactagaaccagacctttcttgctgaatacagaaatgctcaaaagagcagtctcctcttgggactcctaaatgcctggccaagactttctcaggcttgcagtgccatcagagacattttctacccaatcctccttctttaactctctcttctcacaggcatcgggcctgtattatggtctgaaagagctttcttgcctcctctcaattcctcacccctttgacttggacaggtgtttcttttcataaataccttctctttcaacatcatttaagggttggctcccaagaaaatccagacttacacaagccatgatttttttttccataacaacacataattcttggtaatagtgttccaaggaaacgctttgggaaatgatttaagccaaacctttcctgagtttccaaacttgatttctggcaagtgaggaaattatagaaacataaatttgggctttagttcatccatacttttatagtaggaaaatatcatttttaaattatgcatgtatctttttttcctttgaatcctttattcatttccttcagaatgagggttatggaaaattaatccccggtggcagagtgaatcccttaaatttcttttaccaaataatcttaccattcctatgtatggtgttgtttatttcactgaagtatgaatttgaagcaagtactctaaggaagaaaaaatataacagtaaatatattttgttcttttttaaatatcacatggttttatttcttatctgttcttaatcagtttttataaggacctcagccgtgagcctagagatagaaaagaaagatgtttcttttcacctatagcatattcgaaagtttaaatgaagtttattcagagtccttagttttaccaattactttttcctttcttggatgtacaaatctttaatacactaaatgcagcttctataattttaaacaaatccattcttcaaaccaaaccaaagatagaataacttttataaaacaggagacactttagaggtatagttagtagatatttgtaattttcatgtgtttgcagactctgcaatgttgctgtcaatatatttttagtttcttcctatttgataagggtataccatacagatgctgctgtggatgcagtattggccccagtcagagtcttgttaccatgagaatctctgctctaggcactatggccctccgtgggcttactaagccagacaagcttccaaagagaatgtgatgtttgctgaacaacatggaaattggatataaaacctttatttcttttttaaattaatttttaaatatcacatagttttatttataaatgaaattaaagaatgaataacattcatattcaaactgatgaaaaaattggcacagtaggtatattacattgggcattactaaatagtctatgcctcatgaataacttataaccagaaacatttttgacaccctcattctttgtaaatttcaaagaatatttgaagtgatttaatgaatatggcaactatggaagaaaatagattcaacaaactaatacaatgacagtttctgattttaaattaaatacctagaagtgattttaggggactaaaatcactaataatttttccaaggtcagcaactaaaatttcaaaaaatataaaatatcttagagtatcatttattcacacaatggtcttattaaagtcttagatgacaaatacctctgctaggtactatagatttttattggaataagcctcaaatcctggaacctgaaaaaataccctacattggaattcattttcaagtacttatgactagaatgtatttagcttcaaaactataatttgattttcattcacaatagttaaataattccttttggatgggcattttcaaatcaagaagactaaattcattactttaatgagataaattttaaatgaaccactttttataaagcattcatattgggtaatttttgtaatgcatttctcttaatgctttcaaaatgtcctttctcagaactcttgtaagggaggctgagttaacaacctattattatgtactccttactgagctgttaatagctttacagtctctcaaagaacacacctgctgctcataaaaacatttgtgttgctacagaatttggctgtgttttaatatcacgtatttgcagtgaccttgtagaatccgtactgattctatatttttagggaaaaaacaacaataaagaacattgtccatttatttgagtatattaatggaaaattatgaaataatttgattaacctaagggttctaatatttgaaaagttggttttcaataatggttttaaatttcttggtaattttttacactatgtgagattgtttctattttcatttttgaaagtttgttatctcaatttatatgtgttgaaataggtttattttcacatatgtgtatattttaattagaaactgatggcttaaattctattagaaatatcaacatttccatagattaattgaaaaaagtaaaaattgaaattaatgtagaccttttaaaaactttaagtcaaaaatatcataagtctataatgagagaatgtaaaattttagttaaggcagtatttttaaagtttgtcatggttgaatagaatataaattaattgtttttggctaagtttcagttggcaaaggcaaattgttccccaaacctgtgtttgatccttccatttcagacaaggacatttaaaaaaggcaatcaatgcaataattatttccatatgtcccttgattcgtgtgatttttatggataaaccacagcaggtggatgaaatctttccatcctatctaatttagtaatacctgaatatatatagctattacaactcctgttatccacaactccttggtaattttcctcctatttattgaattatgcatcacagcatttttctttctcatgtttaacacgtttatacttttaaaagaccaccagatagttcttttcatattttaaaaagatcaacagatggacttagttcaattgttggttagcacaggaatgaagggttttattgctgtccaccttcaacatggcaaacagatagcggtacctgccagatgtatagtccttctaagctcctaaaacatgcaataatcaatgattattccaaatcactattttttactcttgaatgtcaaaatggtttcattgtacctatgacagctacatttacaactagtcaactggtcttatctacagaaacaggcaactgacttaagactcaagttactggctatataaagatacctcaagacgttgatgttattcccacatatagatctcaactgccacttaattacctaaagtgccagacccctgggaattttgctgacttatcctactaattttcttgacatggaattaaaaggtggtggtgttctgggagattaatttactaaacaacaaatgcaattccatccactaactcaaggtatagtttattattaaaatattacttcttactcaaagtgacaaatgttttcagcaacaacacaaatatctatttaattacgttcacaacagcattgataatcattctaacatttaatgaggatgtcccagcttagaaatcacttcacatgcattaacattcgactcattacaatattgtaaggtggatagaactgacgttttatgttactttttaacaaagcatgctgtgtctcagtaataagatgaaaggcttatgttcacctgtcttgtaagtcacagaaagaagcactgtttcttgaaattccaatccagtgctcttattaataaagtgtattagtctgttctcatactgctatgaagatactacccaagactgggtaatttataaaggaatgaggtttaattgactcacagttccacatggctggcaaggcctcaggaaacttacaatcatgtgtaaggcaaagaagaagcaaggacctttttcccatggtgggaagagagagaagagccagaagcgaatgggtaagagccccttataaaaccaccatatgtcgtgagaactcactcactatcacgagaacagcatgtgggaaaccacccccatgacccaatcacctcccactgggtttcttccttgacatatggggattatagggattacaacaggagatgagatttgggtgggaccacagagccaaaccacatcataaagtcatttagtttgcaatatagaagatcctgttagaaactataaaagaattagaaacctcagtttaaagcactgtgaagctcatagtcttttcatctacggcatagatatcctcctaaactcagtatggtggtaaaaactgaaatggaaatgcaaataaggaaaactggtttggcctgttctctacaatttgcctgttctctatagtttgccttcatagatgagcacaggtatgtaagttaattgttgtgataaaagaaataagagtttcgttcttcctaatgagtctcttaccttacatagtaaaaagagaagtgaatatgtgtcttgaggtcattagtgttatttgatgaagactcaaaatctcatgaaatactaacaaaatataatctttttaaaccttaattttttttggacataggcaaatctcattttaattgcaaaagacttcatttacagcacagtcaataatgaaccaacaggagagttgctgactttggaacatatgaatatataaaaatcccttgcaattcaggtagtcgagataataagggcatgcaaggaaagcaatcctcatttttctgaaaagttttacattttaaaaggtgactaggcatacttggaagttcaaagcagtaggatgtaccttgcagggaaagaaggaggaaaacccttttgccatgttgttagaaaaatgtatatcaaatatatcccaattccatttgacaaagtcaggtggatgaccttccttgaaccaggctagggcagaacacttagtaaaagtgggccctgggtgaggatgcgaatccagaagaagagcaccagatcccctgcagtaccaaacatatccgttccaccctctaacacagaagaggcacgttgccccatgtccctggacacgggatacatgagaacagtcatcagatggttactacccccatggcttggtgctttctaatggtgttaattcaggccatggagaaaatcctttaccaccaaacaccttaaatttttatgttagactaagtactttgaatttcagagattcttatactatgattagaattgtgacatttctgtatatggaatccatattattatttcttacatctgtgcttctcaatatattactgaaacagaaaatataaaatctaacataggtaatatgtaaatcacttagtgacatttagctgtattgcaatacctcacattggaagctgcattgtgtaataagtaacagcatagaatttagagctagacttcctaggttcaaatccaagccctatcagtaatttattgagtgatcttgtcatctgtaagacttaattcatatagtagctttgagaattttcttggttttgagagttcttcatgcctacaacatagtaagcagtatgaaagtgttcatattaaaaaaaagttaactgcagtatgtcctgtgtaaactttcaattgatttattttgactaatttgacatgtcatttcaggctaaaaagtcatacgtccttccaaagaaccagataattgtagtgtttattttggttaagttttgtgtgtgaaggcaaaatagcatcagccaatctagtgacaaaaaaataggatcagtgaactgttccatattaaaattgaggactgttaaatgcagaataatgtttaatcttgttccaggtatctattattgcataatttttaagccaaaatgtagtggcttaaaaattataattcataaatattgtatctcttgaatctattagtcaggtattcagacaggacagagcagaggcagctcatctctgcttcacaatctggacctcaactgggatggcgaaacaatggctggtggctggaacacctgcagaatggctaggcatcatctcatcatactctttctctctctctcacctctctttcttgcccttcttcccaccctccctaccccttattcttgccatctccatctttctaaggctcctcctccacatgattatcttgggcttccacatagcgttgcagtctcagaccagccatacatcttagattgccatacagagctccaagacaaaagtttaaactgccagttttctttgaggctgggccaggaactggcagctcatcacttctaccctacttggttggtcaaatcagtcatatactagatcagattcaaggaaagggagcacagatttgacttgtcaatgagaagaatgtaatagaatttacaaacatctttattttaccatgctgcttgattttaggccttcataatattacattatttgcttcgcttctcatttgtaataatttaaaaatatgtattttcagtactgggtcaaaacaaatttattaattttgaatatgcatgacatcctaaaaacttgaagtctacttagtagttgtatttgtatctggaaatattatagggtaaaaaatagttaattcataaaagcaaatcaaaaggtgagagaaaaaataaagaacaaagttgtggaaagaaaacttccacaaatgagttttttcagttatttgaatctggactatgcattgagttgagccaatgtatttacaacaatcaatatatacagatgaaattatccaactttgaaaatgagatttctgcctgaccaaggaaatagcatccattactcgctcccagacccctaaatacatagtccataaatatttaacatgggcaacatgtgtgacctctgcagaacagggctcttcactgccgtggagttatcttttactctaaatttaacttatggcttcatcctaggtatttttctttctttccaatttgattttaaaaccagcttaggtttatgagtagataaatttgttcactctttgataataatgcagattaacataatgtttctgtaaaatgaccttgctttgccttgaattactctactcgcatttaaaactatctgcagatattttcacattcaaatgtttaattttaaacaccttattagaactacaaaaaccttttgtgtgcgaaggtgtgtacttcaggaagctgtcaattattacaatgtatttattagtattatattacttatagtcgctcagtgatgagatatttagttcccagttacagtatcttgacaagcctttattttatgttattttattataaatcttgaggcacacatttgatatcttctgaggaaattcaaaatcagtgatgaagttagatcattatttgaaaacattgggttatttagagcataataggataattttcaagtcaagactatataacttacttataaagaatgttaaaatctttattttggggaggagaaactggatttcttgaatcctttgtagctttgtaaatcaatcttaagagatacctgctttagtttttgaacaaaacaaatatattggtatcagatcacaattaaggctcacaaacaaatataaaaaaaatttaaagttccaccacggtgacaaaatacatttaaatgggaaaaagtgaaaaataaataattagaaattgttttttcccctgtcctaaatgagggtaaggaattctcatgcttatatatttaaatgaatttctgctgcattttcaatgcaagaggcagctcttatattactgttttgtggccgatttggacaaatgtgtgactttacatatattcacaaatgatactgtttttcagtgaagacattcttgcaaaataatttttcatgttttacaggcaatttcactctagtgaaaatttacctttcttagctttcttatttactttaattctgttggaaactctagcaaccaaaagacagttttggatgccagtcaaccagcatttgctctctggtaatttcatcttcaaagaatttttatctgctaccttttattactcttaatctgtcctataatccagttagcactactgtaaaaaaatccaatgcactatagttcttagataaattttattgtgtataattaagagatacaacaagtgcattcaacccgcggcccacacgtggcccaggacggctttgactgcagcccaatacaaatttgtaaactttcttaaacattatgagatttttttttttttttgcgatttttctttttttagctcatcagctatcattagtgttggtgtattttatgtgtggcccaagacagttcttctttgtccaatgtggccagggaagccaaaagattgggcaacccctggtatacaacatgatgttatggaatatgcatgattttagaaagttactatagtgaagcaaattaaaatatccatcatctagatttttctttttgaagcatatattatttcccccacttttgttgtttttcaatccgcatcccaaaattagatataattaatcaaaggaccatgcacatgttgcctttctagtttccctgcccctccattctgccatgtcgttataatggtttaactttgaaaatgttcagtttgacatttggaatagcatttatatttgaataaatcaacatatgtgtattaatgtttccaaagatacttagcgtgttattttctctcagtggcatttgttgctaagttatgctaacttttatcatcaaagttgtttttatctagcatttatgtggctgttttaatacttgacctaaactactgacatcagcaggaatttgtaaactcttctaagaatgcataaactaaatgtaatactcaattttttggttgttgtttttgtttttgtagaaacggggtctcactatattgccaaggctggtctcaaatcctggcctcaagtgattcttctgactctacctcccaaggtgctgggattacaggtgtgagccaccacacccagcctcaaattttcttataataaatatattttttcctctccattttccccctttcaagtcattttatctatcctcagtagtccaataaatatgtattctttaaatgttttgctctctgctatttatatttctgagttttttctatccgtatattgttattaccaaatttatgtgtgattttaaaattctagtaaatgatctaaaactttaagaatgaatgacaaatttaaagttgttgtttgactataatatacttttaacaaatactattaagaaatgttggaatgaaggcattttcttcagggccaagtatcaaactttaaacacttaatttttagttgaacatcattgtaaatatttatagagtggtaaagcacagaagaaaaatctgtatctcatctatctacaggtaggctacatgaagacagacgggaaagttaaaactgaataaatatcaagaatatgtattaaaagatatttcagcacaaatcttagtttctgtatagcatactgttttgtaaaatatttttggcaagtaaaatcttggacattctccacaatgttcctaagaaaacaagtatgctatactgacataatattattacatttaggttgtagaagcactatatgctagcaaaagtaatttttctcatctcccatttgaattgtcattaatttatgccaacaaacttttaattgctctaataatatttaagaatttaaaagctaagcttatggagcaattaattcattttttaattcaatcatttggacaatatatcatgagagcctacaatatgctaggcatactgtattaagtagttggaatataaaggttaaaaagcaagtaaacacaacattttttaagacttgtcacagcatctgcaagatgaccttaaggcatgagcctatcattgccctggaataaatgcaccacccattgatagttactcttaaaagaaagaaacaatgctacgttacacacctgctggatcctgtaaaacagttttacatattattttggtttatcttacaacaagcttgaccctttgatataggtataacctttccagttttcatagatgaactgactacaactaggactctattggtctcattctagcaccagtattttcaaaagatcacactttaataattaggccattttctctaacagtaaatatcactattaaaagcagttcgttatctatatatgttatctattttattaaaatcaattacgaatgtttaattccagatcaatattcctctatcatcagtgtacttctgtgccttctcctactactgttcaatatttaatgttcaggaatgcattaaatattcattttaggtgaaacaaggtacacattggtaggaatatatgaaaatagtcatgaatgcatttcaaagtgatttggggttatctgtaattttggattactgggaataatcaagagttgattgtagtaaattatagtagtagaatacttaatgatacgtccccagaaatgcagtcaaaaagtagttgtgtacatggaataactacttctacatttttcttacttatacatattttgcaattttgccacaacagtggctaatttttacctaagaaaaacattttagagcaccttacccactagcttaaaccaccaaggaacttcttaaccctttctactcacccctcaccattagaaatttcttcttgtgcattttaatgaatgcgagaaaagacaacaactctgttggttgccaacaacagaacccagctgccactactatttaatgttgtcacaatggagaatccaaggcagagtggaacttcccagcctcagaaaggcagaaaccaggaaagctaaggttgttcaacttcagtgatgtttctttgtcatgggttcagtgaagtttctcatcatgggttcatttacttaggaaaagaattatatagttattctagcttgctcttgtttctgggacagttggccagccccatcttacattactggtagattatagttagatctggttataggagaatcagtgtgagctgaaaggtatcctaatgtgtgtcgctatgtcaaagcagaaattttagtagttcaattcccagtgatatgtgaccagagctgcagtaggtacaccttatgttaaatggtttagcgattcctttgtggatatcaatcaattgacattactaaatactgactatgcatccagcactcctttgtttcattttgttttgttttttgagggaaatgtaaactacatttttcaggaaattgcagcccactttaggatacatacggatgcacattcaataagtagaggaggggaccaaatcgtataaaattaagtgctaaatgctggttagaatcaaagaatttaaagattaatttatttaagatgtctaatttccttactgtgtaatacctttaaaatattcaaatgccagtcttttacttccttggacagttttaatctgttggaaatataaggccaaattgagaaatatatagtcatattagaagattataaaacatcttacaggcactctctaatgaagaattttctaaagagtttgatttcctcaattgatatagcatattgctcctaaaattctgaaattttactaattatttttaaacacttaaaagcattcatacatattgatcttatatcaggacaaaaaaatttcaacaaatttcctgtagcagaaataattatttgcaaaccattaacaaaatcagagaaattaaaaaaaacccaccacatctccaatctatttattttaaaaattttaattttatattaaataatatattaaagcataatagacaaattatgaactatttaaaatgaaagacattaagatcctcacatatctaaaactgtgaaatgtgaccaatgcagaaaaataaattagaaggaatgagcaagtgtaaaatcaaaaattaatgaaatagaatcactaatatttgatttgaaaatcaaaagccagtgtttttaaaagattgatcaaataaacaagcttacctaaaaataataggaaatgttatttacgtatggaagagatttttaataagacaagactagatgtaaatatatatcaataaatataaaggaaatataataattttacggtaattatcaaaactgaataaggagaagatttgaatatagcgtaaaataattttaaatgatagtcaagtgtgtactaccaacatggtccatttcaattaagttttcaaagagcagataattcccatgttgtgtcagttattgcagaacattaataagtggaaagtttcacaatccgttctctaaatatagtataacccaaatatcgtgagattgaaaaagaaaactgtaagctgagataacttataagtatatgcttaaaaattttagcctgaaatattaccatattgaattcaaaattacaataaaaattctaatatattatgaacaagtgttaacaggaagggtttatcttaggaatgcaaagatagttctgcctaagtatatactttattgagaaaaacataaaattcacttggcaacagataaattgttttataacatccataattcatttcacattttaaaaacaaaatacagacaaacaaaactacaatggaagaagaaaacgtcctcaactagacatctgccaaaaatgtaagtcagacataattatatttaaccataacacaattagaatctgtttgattaaagaagaaaagaaaaagtttctgtttttactgttactttgcaatattatgctaaagcattgcaataagaaaaaaaatacataagaaattgtttttggtttgcacagtaaaatattatagatgaagttatataggtcttacatactttttgtgatatatttaggtattataaggtttctgttactatagtgactaaaatatttaaaatgtaattataagtggtcattgctagtatacaggaaaaccactgataattgcatgttcactatgtaactgacttctcttgattaattctaaaatttttttaagttaattctctcggagtttctaagtaaacatttctaactaacagagagaaaatgatgatttatttcattcaacctttaggagagacattttctacatatattaaaaaactgttatttttaagttttgtaagataattaagttatgctttacaaagaaagaacatatactttatgatttggctagagtagaataagattttctccaactagctttaaaaaaaggagtagattaaaacttcggatgaatcaaggcaacttagaaacaagaatagaaatggatgactttttatgactataagctcttttatcattattcctattttacagaagtggtataactcagttcctgggttcacacataactcattctggtactctattttgtacatcttgaactggagtgcactcagagttggtaactattcaggaattgatttattctaattaaatgctaaaagagactgaagagggctgggcatggtggttcacagctgtaatcacagcacttttgggaggccaaggcgagtggaccacttgaggccaggagttcaagaccagcctggccaacatggtgaaaccccgtttctactaaaaatacaaaaattagccaagtgtggtggcacgtgcctgtagtcacagctactcgggaggctgaggcagaagaatcgcttgaaccacagaggttcagatcacaccactgcactccagcctggttgacaggacgagactctgcctcaaaaagagagagagagagagactgaagaacaaaccagaatattcacgtattaaatatacagaagtctgccctttccaagaacaaatatatttatgtttgcccctacagagcttgagaatccacattagtaatcagaagattgcaacattaaagtagaaatatgaaaaatattaaggactctttcagccagaatatgatgactatgtgtacccaggtagaactcatttttaaaagggtcagcaaaataaagtccacggggttcagtgtctatttcctttggaaagtaattgttaaaggctgaccaaatctagtattcaaacttttcttttcccagagccatgtgaaatatcttcctttcattcaagtaaaagactttcagctttgctaatgccatagttcaggcaataagattttttgatagcctttctaactttaggttcctaggccctgcaattcttgatttatccaggcaaaatacctttctgcagataataaatcatgttctaaatgtggttttaattcgtttatttttgtttattttgagaggattatcctggaaacatctccacagtttgatgaatgtgagtgtgtacatttgtgagtgtgacagagaggcagggtgaggaagtcaaacagaaacggagagagaaaggatgtaaatgacttagatgacttctagtggaaccattaatatccttttttatattattttgtttctcaaacaacctgtagcttcagtcctctagccagtagaacaagagctttaccactgtcttaattaagacatcgcaaaaaaaaaaaaaaaaaaaagatttggatagtagagtactacatattaatagcacttggacctattcctgcacttgcacctatattttcaaatcggtatgacttaaagccaagaagttatctttacacatcaaaacttctaaaagagtctcctggactttattaaacaaattctattcccaggcttgaacgagaatactgtatattccatgcaagactgggtgatttatttgcctcctatattacttaatatctgcctatatgacataaaattaatagaaaataaaaataaaggcagcctgcatggatttgttaaccttaatagaaaataattttacctttgaaatgtgtatttaaacatttggtgttgagaattttttcttccaattgaggaactagttgttcatataaacatagtctaatgattagccaacaaatcattactatgtggtccataaggtgtgttagttacttctagtgtatagatagttaagaacataaagtgtggaaaaaactactttggctcagtctaatccatagacatatatactctggacatatttgcttaaatggggtgtagtggaaaaagcacaacttcgatggaagccactgacaagttgtgtgacttgttttgctaatttacttattctttctggactaatttgatcatagataaatggaaataaaaatattaccagttcttatttcacaagactattatgaagattagattttagatgtgtatgaaaacaccttgtaaattgtaaagctctacataaatcattgttattatgattgttgttatatctttacatagatatgtctagaaaataaaatataatttttatcttacatttaatccaattaatttaaaattaaaaataaaacaaagaggtgacaccttttagaaatcccaataggcccaaagactttaggagaaagcaaaccagctaaaagatgaccactatgctggcctattgaatctattcccataaatggaaatggtaaacccaagagagggagatgaggaatgatgacaatgattcatagcagaaggaaaaacacctgcatttctgacattaaaaaaatattgaattgaattgctaggtagaacgttggtgattacgtaagctacacctaacaaagtgttctagaaccttatacataccatgagattcaatgaatgtctgtagaatgaatgagtcttctagaggagtaaatcaaaacctaaaaggtaatttgccagggtacataatagaagcagaatcaagataatatccaagacaggagaactctaacctagaattttttccatgctgtcttctattgatacaggccctgttatctctgactgtagaaagatatagccatagggtctgaacacctgagcctatttgttttcaccaagttatagttttcagattgaatgctaacaggttccagactctagcaagagggtccattttagttaccatgaaaagttgacacctataaagctaagttcagtatttcaggtaaacgaaagattcagtgtgacagtatgattcccagaaaagccttgattctcagcatcttggaaggagcagtgcctaaatataagtgccagggtcttcccatgggaagagaaccataggtaaaagtcaacatctctagagaacagtatatgcctgccctgtttgacagtgctctacgttcacactatttggttccaaactatttttttttaatttggatacaaatatgtcaaacaggaattgtatgtatgttttattttagaaaatgatacaacttaaaatgtgttaaagttcattgcttctcaatgattttttctcacaattggtgctattttctgtgctcatccgaggagaggtcatgcaacaagctgattcactttcagccgacaagcattagtgcacaagatggccagtgctctcagccaatgagcatccactgcactattcacagttgagtatgctttgcaacccacgcaactatgcctttggaggttcactttatgccatttatttactccctgataccatgtcttaatccacaaaaatgtgcaagtaatagttcttggtctcccacaaagaattttttaaatcatacttttagatattaataagtacttagaactaattaataataccttgtatgaaaacttatgaagtataactatagcagtacttagcatgaaatttgtaagcttaaattatatatttgaaagaatgtgctgataatgagttaagcatgaagcataagaagttagaagacaacatatctaacagaaagtacaaagaagaaagaaaatttatagtaagaacagatatcaaatgtaatagattaaaaaaaaatagaggggaaaaagccaaaaatgtgttcaaacctctggaaagcttgatcatgaaaaaaagaaattataaaaataaataatattaagaatgagaagaggaattttatcacacattcagcaaagatgaaaaacagaactttatgaacaatggaacgtgttccctagctaagttgaagatttacgtgtcatacagctagcaatgccatcatggtacaaactccagaaaagcacgccaacataccctatctaaacatattcaaaattcaacctgccaggatgaagaaaacatctcaatggctctgtggcaaagcctggtcgctacctggtgacaacacctttgaaatggagttgatgcgtcagcagaaaggcaactggccaaaattctgggacgatagtgtcctacctatgcatatcatagacaaaagctaacttggtttcccaagagcttaaaaacaccaggaggagagaggtctgctgtgtactgtgaagaattcttgtgactgcttcttcctggaccctcttcctcatcatgtcagcaagctgtaagacgtaagacaaggcagcagcactcaccggtagtgagtgattcgggctgaagaaccccttaagtacacttcctactgtttgatttttattccaaggatttagctacaggtacacttttgtaggtaacaacaaaaatactaaaagctgcctgcaaaaggtgtcctttattccctgtaactttactgaataggaagttactatttagctatgttttggggaagcaacaaggataagatatgtaattatcctggagccattctaagagtaaacttttgaaccatatcttctctcttttgggatgagactaaatgctttttttcattgctttaaagttcttatctcagtcatcatttcacactgtgagacagcactcaaaatgcaccataactcttacgttgtagaaattctgtgaaaagtaacatatcctcctcttgtatatgagattgaaaaatccaaatgttctagaaattcctgccagaaacaatatctttttttctaatagttcacaagtattttttctccacaatatgtgttttaagccacctaattataaaggccttgatatgagcaagctcctacatttaatccctaacagctcactgtcaccatcgatgatttatagactttatttccttgtattttatgctaggttgataaataattatttactttctaatcttaaaatcacctagagataaatataagttgcagttttttggtttagtctttttttatttaaaatgttgctgttcttaattcaatttttttccttgtactttatgtttaataagcagttttattatttggggtataaatggcaaattcaattctttagctagacacagaataaccaaatagcatataaagttctgacaaggaaggtcataaagtttaaaaatgatccttaagataagacttttttctgaaaagtagcttaagagaaatgattttcatagttctaaatcttaaagcatcaccagcaaatacatgaagtttgacctattctccatatgtgtacattttcataacttgtcttgctagttgggaaggtctcctaaataacagtggttttcaggcaaacactaaatgaaattttgatgggaatattatagacagaatttaagcatcaaatgaatgattcaactagtgaccttgaaagtcattttgcatctctgaaaatctctagggtttttatgaggatggtggaaattaacttgagggcctgttgacctagcttgacctatgacttttgtttacacaaatgcatttttttccagataccctattaaaatatcattgtaaagttattgaataataacaccatacaaaaacagtgtaggtttaatttgtccccaccaccagcatattgtggacaatctcttacatggacaggtaaaatgaactgtcctgttctgagatagtgggcaagagagaccatgtaacaaaccctgactgtctagatcatccagaatgccctggcaagttcacttccatttagtgaagtgagataatttggcaattcacgcaagagactgagaaccaagcctcaagccctgcctctgattctgcaggtatggtaagtctttcatgcctttctgtgtttccagtgcttcttcatgggcagattatttttaaatctacttcacagtcactatgtaactagtatatgtttaaaaataagctatatttaggggaggagtcaattctcccttacaggaaaaaattcattattttatttcctaaattttattcaacttcaggttttactactggggaaacactgaattacagcacaaagtgaatgacttcaggataaaagatttcaaactttaaaaagcaattaatttatttctcctttcacccacaggtctacccacggatagcgccggcattttggcactacctgcgggtagaagtgagtagctggtacttgaattctcccacctttgctccttgcactctgctggtgtgcccattttgctcaagatgcagctgccattctgtgtaaacatattctcacaccaccatcatttcttacagttgggtcaggaatctaaatcaccaaaaatacaagtgcagtttatataagactaatcatctttcttaataaatttccaaataggaccatatcatatgcatcattatgataaacagctaaatgccaaattatggaaaaccatgctaacactactttgtaatcaatacttttggtattcagagcataatttctcagttaaactttggaatgtttctaggaaaaggtagaataactctgtttcatttcctttctcctttttttctgtcccccaggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagtaagtttcacacaaggatataacataagatgtgaatttagtatcattccaatttgacctgatattttaaaaccaggtgtcccaagtttttaatagcttgtttaaatgagattttgttcatgtaaatactcatacagtcatttcagttaatatttgttgctatcattaaatgctttcatgaaatgccttactctaccataaaagtaatgtggccaaaatgtggccctttatgctattacacagagtctctgtggatgcctaatagttcaccagtcctggcatcatgatatgatcctaatgaaaacttgggagagaataaagccgtgaacaaatggtttaagcaattcagaattgtgcagctttggccttttatctcagtcaataaaaatagtggtcaggagatgaacaccactgacatgcacattataggtttaaatacagatgcatgggcttcatcagaaacccacattaattccgggacctcaacatgctgaaaaccaaaatgggagatgaagggagtgagatattccaatgtcatgtaacatcagctttgaggtcttttattcattctaaacccagctttaccaatgaactctttttggccttcagaaatccatcttactgctctctttgtgagaatagtagggattgcttttgccagacatctttatgaaaaagtggtcaaatatataagaaaaatctgtttccatcattgttaacatactgtattaatataataattcaataaaagtaaatttattatagtaattccttatggataacaataataatagcaagcatttattgagaccctaaaaatgcctaaaatgacattaaatattttacatggaattgttcattcaaacctttcaacatccagtgaaacaagtattatttttgtaattttacctataagaaaatagaaacctaaaggagttgaacaatttgcccaaatttaagcaactagtaagaagctaagctaaaatttgaaatggaagcgtgttttattgaaaggcctatgctgttagctactccaccatcctactaaatcttatcatttgtattattatgaagtgttttttgtaagatcataaaataggtcatagtttttcagtttatcactccctcaaaatgaagctacttgggtttcagattctatgacagaaggaatattttgttgtttttacattgatgaacagtattcacatgtaagaacttctttgttacaattatatctaactacaaagggagaaagtgctgatgtatttaagtaagaaataccccaccttagggagaatgagtaaactaattaataaaaagaatacttgtggcctgagtatttatatcagtaatagtcatttaaatttctggtggagactattgactttttaagctagagagaaaattattaggagtagagtattatgatcacaaaacatagatccacaataaaatccatataaaaatatcaaaagatttgtccctgttatgtctttttcactttttttcccctgcccgcttgtcaaaccttagcctaggtataaagctaaggatacagtccaaggaaagtttggtccaagattgtcgaattattgtcttttttaggctgtgtttcttttcacagcctggaaaagttaatagcttttgcacttctcttactttatttcacagatttaaaaaattcacctgacttttaaagtttgacattgttgagtattgcatttttaagtgagaaatgcactctcagataaactcatagagctacatctaaataagtcatttgtgttcatttgggacttctagagaaggtcatttggtgtaatattaacaaaaattctgatttaaatattaacagtttgatttggttttaacattagatttcaactcattgtactttcaagacaatttcttcagatgttatgtagaataaaaagaaaggttttgtactcacaagtaactcagtacaattcactcattcaaccgacatgtatagaatatttaatatgtgccatactcatatgagcctctggggataaaaaataataataagagctaatagcctatgccttcaaacaagtttcagtctgtatttctgtgaggaaaataaaaagtttaaatcaaaaatacaagattagtgacgtgtactatcataaagatatacaaaggatatggtggcagcatagtgaagatgactactacttcagcacacatgggtggtgaaaggtttctggagggtgagaggctggggttctttcttgaaagaagaatagtcatggaacagaaaaagcataaaggcctctaacaacataaaaaatttaaagcgcaaataacttggtgtggctgtggtgaggagatgaaaattgtaaaatggtggtagatgaaggtggagagttacacaggggccaaaccaagagcactttttagccatattaaggatatttgcatgtatccagaaaatattcaggatccattggtgaattcgaatcctggattaacatgactagtaatacatgcaagaccctatgctgagcaatttacacatattacctcatttaattctgacaagattatgcctcattttagaaacttgtataactttaccagaatctgatacctagtgattgggggtgcaagtttagaaccctagaactatctgacaatggcagcagaagatggtgaaaactatgttctgaattactgattcaggaatgccgcgaaaatgactttgattaaaaccttgaagagataaaatgtctgagaagaacctgaaaataatatatttgtgtaaacctgatgtttgagaacatagaatggctcctaagtcaatttacagtctaagggaaattcatttaaaggatcattaaaaaaaaaaaaaaaaactggttagctttaaatagcattttcaaagcctgctgtttatacccaggagagaatttcaatgaataatgccatagtagcatatggataggtttcccataaattcaaggatatgatgatgtgaatcccaattgacggcatccatctttttctctccgtaccctcctggctcttctttaaattttatagcctttgtttctcaagtagtgcctgaattattgtaatgtcagccttattattaagttctctcttgtgtattccacttaattgactaactttataatacattcatagagatgaggtatgggttggaaaggagtgatctcatttgatgatctggttcaaattttttaaagtaagcaaaattaagtagtttataattcagttctttttagccatactattttactttgttcaactttgactttgctaatgaccaaggcaataacataattatgaaataattccttttgaaaatcataatgttcttgactggctacttgtgctataaacatagtggcatctgaagaaaaattatggcgaccctcttgcacttagagaccagtgcttggttctttttcaatatcaaaatatgctagtggagattctctaactggctgacaaatgctaagattactaattatcactgttagcatcataaaatgaatctacttgaactggagctattggtttcccctctaccgaaatctataaaacaaccttattgcatatatgtatgtggaggtagagatatagacagattgatagatggatcaaattgactgaagatattcactcatatataatcagaaaattatttccttgtattttaatgttcgcattttatgtattttctgatttctcgctgggctaagtgtacagttaatattatgtccactaacagcatttattgagtgcctactgtgtactggccttattattaggtactgtacttgattgcccccttccttctttagaatagatttatcaaaactgcaataaaattacagaatcagtagtaagaaagtaagaatataaaaatacttcatatggattttcttgggagatagttggaaattaggtgttagaagctagtaaaaattttctcaagattaaaataaaatctatattatgccccaaagcattaaccataacacatatccacacacacacactggtcaaatacagtcctttttggcttatacagctataataggaaattttaactgctcaaatttattattatttctgagcttattttctgggcctttcactgcagaaaaaaatgagaatcaaaataaaaaattgttgacatcaccagtaatattagccataacttataaattgcttggaaaaaacatatttgatacattttaacaataatcctgttaaattacacttacacattttaaaaagtaataaaataaagataaggaaataaaatttttgtttttatttaaagcactagcaagatttatataacattaaattccatatatatagtagcagtaagtaattttgcatgtgcagttttaaaaccaaaataaaatgtattctgctagattgtagccagcttgaaccttctgcttaaatactgaaaaaatagcttgtgagctatcaaaagggaacagaatccatagcttaaagccaatttttgaaagaaaattggaattttacatgtagtaattggcaatttacctcttccattgccttaataattatctaaatgacccacaagaattaatacattgccaacatataagcaatgcattcctcttttctgaaaagattaattacagcttacattttaacaacacgtaaatttaagttttcacctgtaggctgcataaatcagttttgtagcacaaaagccacatctgtcagcattttaaaatgtattatttaccaaaagtagtaatgatggactaaatttatagcacataaaataatcatataaaaatcattataatcaacattaacaaaccaaactgtaaataactacattatagtgggtatttcaaaataaaatcttatgtcgtgccttatatatttttacaaaaagtggtatgtagatacaaatgaataaatgtaaccacttaattattttgaaaatatccataagatttagctgtttttgtatggttgatatgtaagaaatttggtttgttttaaccatttataggtaggaaattatcctaaaaaataagatgcaagattatgtttcggtttcttcctcccaatacatttttatgtccccatttgatgaatttttctaaattccatttgcacacttaaaagttctaaatcattgcatatgttgtattgaatagaatgtgaatttctcagcaagatattaggtcccctctaaatgtaatccaaattgatatcatttctatcgatttctgcaaattaaggtattctctggaaaaattagattatttggatgcttcatgaacaaaataatctgtatcttcatcatatctaagattcttctatgacttccaactggaatattcagaaaatgatcacattacaaatgatcactctagcttccatgccactttcctgaaatgttcttgccagtgagaaatcatcacttcttccttggaatttctaaatattttattgttcaaaggcgtaattctttactaagttgtaaactcattgagataaagaactatagtctgtatatctgtttgtctcagaaagtgttttacacatagttaggttccaatatacatgtaatcaaataaataaagaaaatatgatttacaaaaatactaaagaatggtatgttgcctaccaggtcaaaaagaaaaagaaatactaaaatactaaatattaatattaaaatactaaagaatagtatgttgcctaccagttcaaaaagaaagaatcagataattttatttgccatagataagcaatattgcttgctttattttgggtaacaagctataactggcttgagtcatgtaaaaacataatatatgcaagttttactacaaattaattgttaattctaaatttgggggcacattttaggtagggtaaaatgacgattttgttgttaacacattttcttccctaaactcttttttaaaaacctccattatgtttgatccagtctgttggttgaagcacaatctgtactgcttcaattacttaggatgaaattagccacatcattattaacaccagctagaaattttggaatgattattaatggtagcacatgaagcagaaagaggaccagctgaccctggtggagtaataaagttaattaatcaagcaggaggcagatttcatatttatgagtctacccagaggaggacaaattccagtatataagactttaatttaaagtaatctccagtcaatagcacactttcaacattggcagccatagccatctaaatgcaaacatcagtgggaaagaggaattttctagcagttaggttgtctgaatataaagtggcctgtcctataaggtagcgaaggcccctcataataagaatttgtgctgaagctaattgggaacctgtttagcatgtggtaaaagaaatccctgctttatttaggaggttgtgatacaagtttaacgtaagttcaaacattgagatttcataacaacatatttgtgagttctaattatgttccaatcacttttttaaaatcttttctggttaccaaaacatgtatagcctttgcagaagatactattatgccaattttacagatcaagaaagtaaagcataatgaagtatagtaacttaacagtacccacaggtagtaagcattggaatggggttattatggcattaggcccttttcatactaatgcttagaaccaaaattgagttccctttctacccattcagtactttcacttttctttttcaccttagtcattatttataattttctacatgactattttttattattacctccaattcgtcaccctcccttaattacttatattttgccttagcataatgtctttgaatataagcggattttcagaagactatttataaatctcagtgcatcaagttcacagagctgtgcagtgttttaatgcatatttctggattaatgtacacatggtagaccaagtataacactccaaagaggcaaaataatgcagttagtgtgatttacttaaatatgcagggtcttgatgaagagtaactatttgcacagaaagtagaagtcgcccttcaagagagactgaattgacaaaaaaaaaaaagatattttatttcaattatgcctagatcaaataaggattttaaatgatgggaaccaggcttatgtaccataagacagattgaagaccttaatatgaaaaatattaaagatcataactttgctaaatgggctggaaagaaaatcattaactattaacaggtacttagatgttgtaaaatgtgcgtatcaaagggcagtgttacagcgtggctcatatttaaaagaaaagtaacaacagtagatctatttcttaatacagaaagtaagcttatttttaaggcaataacatatagcaacatatgtaaaatattatttctttggtatataaaccatcatcccttgactggaagtttttacaagatcagggaacatttcttttgtttctttttttaaaagattctcatttgtgtatgctgtgtgaatttgttctcttagcaaatttgaggtaggcactacagtgttattaactatagtcaccatgctgtatatcagattcttagaacttattcatcttataactgaagacttgtagtctttgactaatatttccccatttctttctcatttttatacctcttatattgctttgcatgcacctggcaagtagaaggcactcaatgaatttcatatgaattaatattatccaataaatacacaatactcagtatttataaatactcaatattgcttcaaacacatgtattttattagtctacttatatatttttagtattttatttttgtttattttgtacatatattaataacaagcaatctgctgaatgctaaggaaacaaaggagataatatatggtctctgtcctcaggaagcttatcactaacccacactagagataagagagttcctgatttatgtcattcccaaagtctgattttaatttgacttgatttgagatggatttttttttctatcagccatcatataaattgcttgaatttttctttcaagctatttgactttacaaccttgaattcttaaagagagcaaaaatgttccttaggtatttcaaattgccccaaatttagtgaaaaatatattctctatgtaacacttgaagagttagagccattcttcagactacacaaatcagctttattgacttgtattttgatatggcttttcaaaagtcgtattttagttgttagaaaaacatcaagggcaaagtgaagaaaacctaatttctcattatattaataacagtatggaggcctattgagaactgttggaatgattcttaattgtggctgacctctcaccctcatctgttgcatggtcatgcactaagctcaagtagggaatacaagtattgtgttgttcagcaagtaccgatagaatgatgttttaaagcattaggagagctctagctggttgtagagtatcatagcgatgatatataaatgtggttcttacggggaaagggtagaaacacatgatgctgagacgaagttggcctttgggaagtcacagactggaaggatgacatagcatggggttttggtttctgttttaattttatgtcctggtcaaattctatccacatggtaatccgttatttttcagagctgaaaaaaaatctgagaattgaatgaaagagttgtaaaaatgtccaagtcaggttaaaagtatttcatataaaatatatgaatattaaatattatatgtttatgtcaaaatataaaaacatcgtttgaaagaatttaatttgcatggtgccactcttcaataaaaatcatttaaaattatctaatgtaacatcttctcaatttgtattagcccaatgcaaaacagctgtttgtgcttttttcaccataaagtcacaatactgaatggacaaatgtttataaaataaacccagccagttccacaaagtcctgtatgaagaattaagaagcagcttaatggccgggcgcggtggctcatgcctgtaatcccagcactttggaaggccgaggggggcggatcacgaggtcaggagatcgagaccatcctggctaacatggtgaaacccccctctctactaaaaatacaaaaaaattagccaggcgtggtagcgggcgccagtagtcccagctactagggaggctgaggcaggagaatggcgtgaacccgggaggcggagcttgcagtgagccgagatcgcgccactgcactccagcctgggcgacagtgcgagactccgtctcaaaaaaaaaaaaaaaaaaaaaaaaaaagcagcttaagtattcatgttacactttactttttcaagggaaacagtagttcccttgaaatttaaattgagtaacaagaattcttggcaaaattgcaggagcgcttaaaagatttagctgtgtgtgcagaaacccaagcatgacatgtgtgagcacattactgtactataaagataggcaaaggagcagaatacggcaatcttactgctagatataaaatagctgattcacatcaaactgaatttcatattctcttatgcttctggaaaacagcattcatttaaaaattctcttgcactatagtttttttaaattagttatcttatatttgctggatgcataatcagtgagcagactaaataactttgtcaacaaataattttggcaattccatcaacaataaacatggcaatattacttactgaatttatcacacgtaagtgtgtgtatatatatgtacatatatacacacattcatatatataatacatatattccacattcatatacacttcctattcccattttgagataaaggaatgaaattatcattattttaaatattgttacataagttgttacccttggaagtaaaaatgatttgttttaaaatttgatatagtttgtgttaaatttaacatgaaggagaaagagaagggcgcttgagaggaagcagtaaaagctaaagcaagcagaagaatgtttaattgttcaacttgttcattcacccatttactcaatcaaaacatattaataaatgggccagatatagatgtaggcactaggaattcaaaaacaaaaaaggataaaccagttccctgctttcacaacagctagtgagaagttcagaatattaaacaagatttccagtagaaggcaatatgtattgtataagggagcacaaggaggaaaaatgcaaacaaatgtgtcaagggannnnnnnnnnnggttgagggaccagatgagggaattggggagcttttgctctttttagacagaacagtatctgtgcaagtgtagagatcaaagagaagcatggagctttctagtaactggaagaatgtcagtatagctagaactgtgcttttccaaaagtgagccctgtgccaaaggcatcagcaacacctgggaacccaccagaaatgcacatttttcagacctcccactagacccactaaatcagaaactctgggggtgggacccagcattctgtgttgacaagccctctgggttattcggctgcaagctttggttagagaaccaatgtcatcctcaaatagcacaacactggcagcaaggaatggtggggatgatgatctcagtacaagaaacacaagatatgtggctagtgaggaccatgcaatgccatccttaccttgctactgaggctcaaatttcctaggtttttatttttcttccagctgtatgtagttttggagacaggcaatccagtcacagcagtgagcttcccgtaactgacttccctgaaaccactgcgaacacatctaattatttcctcaccttcattttaccacactaaaaataaaaccttccaaatatcttttttcattgacactcctatagctctcataacttccaaattccctagagacgattttagccttaaaaaattcacctactgaaggtgctagaaccttgggaatcatcaatttaaattctaatacatgcttgctctctgccagcatttaagcctgcatatgtctctctgacagttcatatttggtctgtgaactttctgaagatgcagtaaattatgacctgctcaccagaaccttctgagaaaactggagctaagccatcccaagtcaaaccttccaagaaaatctagacattaagttatctgggaaacttagtgaatttagatagcttaggggtaatggtgatatgttagcaaaggaaagttggacaccaaaactgacatgccatgcaaaggcatttgtctcaggctcagtaacatagaggtacattctaattggtgaaagaagaaatgctacattcaattaggcatcataggacttggtttcttggctcatgaggattctcctctttagaaccataaatgaaataaagcaaacatgctatattatcttcctttgctctaaaaatgtgaaactctccaggtattgggacctaaggatggcaatgtagttgatttatgttttggtttcctcatgggaaaactagaaatttattcatttgtatgtagagtcattcattcaaaaatattcttgagatcccattctgtacatactcaggctatagcagaaatagacaaaaatccctgctgtcctggagcttatattctagagagatgagaaagacaataaacaaacaataagcaaaacattttatatgcagagatgtggtgtgttgcctagatttccccttcaggacccaactagtgggagttctgcctgctgaaagctcatagttgaaggctcatagctgcagacattgcccctggccaaaagaagctacatgcccctcttcctggggacagtcagaatccaagattcctcaatgtgatgtacaaagacccatgcccattgtgtcaattaaagacaacccagaagaagaccatcccagctccagcactccttggggtccgctgaggtctttgcagctaccacatgtcaagtcaacagctgcatctttccatgggcttcctgtactcccacatgttcatgctgaggtcactccccagaaaacatgctgcaagccaagctccattgcagaatctgtgtcccagtaaaccccatctaagacagataataagagatattctggtgcagagtaaagctgagaaggaggatagggagtatctgcctcctaatgtgagaaaagtactcactgcagtatctgacacaagtaacacgtgatcattcgaagttaactatcaccataatcctaacggttactccaaactaggcaactggcaaaaacttcagggaggatggcctgactttggtcttgaagaaaaggaagaacttatacaagcagaaagaagaaagaaattttttatgttagcaactgattcatgcaattcaatttggcaggtattttgcaggtaaattgcaaaagagaattagcaaagaggaattttgtgtaaaaattcaagctttgtacttacttaaacttggatttaaattttgacttgatcacatctcaaatatgggactttgaataagtcagttaaccactctgtgcctcagtttccacatctggaaaatggatataaggataccacctactttctaaggttcctgtgagtatacagtgattcaatgcatgtaaagtacttaacaacagaagagtatccagctatcatgtggttagagctcaataaatgattattaatactgatattattgttactagctttgaatcttaaattccattctaacagcttcaaaatagtgtttaaaaatgttctttaccttcttgcatatagataccatataaaagcaatcaaatcattttcttattcttctcctgatattttattttttatacccatgaatttactataaggatagttagctagttttggtgttagtttttgtttaatttatataggtgacataaaaggaggagtggaattccccaaggtatgttgacctcccagggcttaagcactggacaatttgactcagctgaagaaactccacgttttgacttctgagataccaaatcttagtgagcacagcaggcaagtcagggggcctccattaggcccattccagcaatatcaccttgtagatccagaactactctctctactgtttctatggtaatcaaattacttagaagttggcctacttttcttttaaacacttaacacatcaaatgtctcagtgcaaacagacaacataggacagtggttagaagctcgaactcaggaattggactatctgtaagtaaattctggttctgtcctttctaactatgtgaccatgtgcaagttaattagcctttttgtgcctcagtttctccatctattaaatgtaggtaataatactaccatttcttatgattattttgaagactaaatgagttaacatatgtgtttaaaactatggagaacacataaaacatgttttttaatatgataattactacccttcttctgagggaaactccactgagttcagtatgattttttggaccatcctgtgccgtgaatcagctgctactcccctacgtaaagaaaaaaggaaataattaaaaagaagaagaatgtaattctggcaaaagaccttttgtaggacagcctctgtggaatcctcctctgttttcaaatggaaatgagaagacttatgtatcatagccacctactccactacaaattttttaaaattaaaataatagtcatctcatgaatgtccttgcacagaaataagcaacttacccgaaaacaagcttagctatatattgaaaatgatatttttggctcagaataggtattaggtatgttatcacttcttgaatataaacacagaatatcttgcttgaagaaggattttacttttcaaattattggatagacacagttttgaaaatatttgaacttgaataaaatcacattttgtttactgagcataataactgaaaagaaggctactccattcttttctaacttattccaagttatctgacagacaaacagagcaccaagtaggaacacaccaaaaagacttggggctttctaattacctttggcacgtgcctcttttttctgtcacgttctgtgctgcagctcagaatgcctttgaatccttgtgaatctttgacaactacttattgtttaacagaatagtcccaaacatatatataactaatttaagttattaatgtcactcaatagagatgagagaaatacaagaatagtccaaatttcatgttttaaacaaaaaaagatgaatttttaaaaattattattatactttaagttctagggtacatgtgcacaacttgcaggttcgttacatatgtatacgtgtgccatgttggtgtgctgcacccattaactcgtcatttacattaggtatatctcctaatgcttttttaagcagtaagtagcacgactttccccatgtatataataacatatctaaattggttttaatttttatagggatgctttctcagaggactaaacagaggaatagtgattttttatctgcatttctcttcttcctaagagcatttgaggcagtttaaaatgtatgcacaaaatgtttaataggttagaactaaaatagaaaattaggtccatatacacaagagggaacataatcattactagagatgcacatgtatgtgccatctctgcctctgaaatttccagtagcagccagagaatagaaaagttatcatacgctcatgaagcacaaatgttctaagaaagatttatagaagccattgaggaaaatggcctcaagcagctttttcaacaaatacaaaagttttttgtttgtttgtaaatgacattttctgactacaacctttgatagagccaaggtaaagtttcaatgattgaagatgatttttccatgatgggagaaaggaaggttacttaattcattccatgcacacagactttaagacaaactatacctaggaagtaaatgaaaggagttaccttttaaatttattttctaaaaattttgtctgttagccaggaacttaaaatcagaataatctaataggaccctttgattgcagatatcacataaaccatgagctaggttaagcaaagaggaatgaagaaatgtcccagactaggcttcaaaaaagattgagacaagaaactggaaaattctccaaaggaaagacagcttttattcctgatccacacagccaccaatctctgttttgtgctctaaagactagttttacctgtgttcatttaggaaaatatgtctatggcttataaatcacatttcccttagtgtcaaccatgcatgaaaattgccaaactgattgtgaatcctaatcccaaattcctgcaagagggaatgtggttggtccagtttgggtcaggtctctgtcggtaatccaatgcatatgactgggtgccagagacagggagaacagtcttccaaactcctgccctgtgggtggagggagttttcagagacagggctgaacagatacctcagaggatgtttactaagaattttgaggttggtctttaatgagtgcttagaatgtaaattttctactttcatatcaatagatgatataaatggtacaaaaatatggtgaagcaatagagaaatccttccactataaatgttgagaagcccaaccagtatttttgcaaaagtaaaaataaaacctctccatgtttatgctaaaatgggctgcaggcaaagcaaagattgtccttaggaagcagatttgaatctgcccccaccgttagatacactctagattgagagttcagagtcccccaccacaggatactgggaaaaaagatgattctggcctggaaatttttcaaagcaggtgttgttgcaagtcatcaaaaagaaacccgaggagtaatgctcccatggaaaaagttatattgaactgcgtagctctgcactgtgctttcctggataagctatagaaaaaatatgcatgtacaaaatggaaatatcttgtctcattgtgtgaagttttgatcaattgccttttgtctgccaaagaaaatgattttcaatttgataaagttggtgatgctcaattctttctggcagcagtaggatagcagaattatttgtatcctgaagttaattctagttgttgaaaattacacccatatcatcagcatgtaggaagatgcttatctttctacctgccatgatggcaaatacccagtttgtctaaaatcagtgccatattgtgaagatactagttaaaaattaataaataaaacacaatactggtttttatattacatgacaaggtgaatgggtatgtcaggaaatgttccctttcatttcagttttagaaagatatttactcccacatttgtagatcctaatattaagcttcattttttacttaactcaattccctaggcaatgaagtcaaaattttgtgaaaaaatcaatatgcataagtaaacaatcttattttcttcaaaataatagtagtaaatagtagggcaatactgtgccaaaaaccttcttgctgctaatacgaattatttaacttggagacctcacacacatggcttaaggagaagcagggtgtaaataattgaagagatgctgaaaaaattgatggagccatagttttgtgctaccatggggttggcctttttaaaatagaatagtctcccattgaatctctccagaattaatcctgatgattgattagaggtagtttgaggtaaatagtttggtgttcttcagaacaggcttcaaacaatgatccaaaagcttcccttagaacttactcactttcaggagatggttaaatgagttttggcataaagcaatagcaggtcctaaaagaaatatacttgggtccataacgctaagaaaaattggcacctggcattgtggttagccgtgcttccataaatagttctactgatgccaaataaaggacaactgtagcctcaaattcatgttaccataaactgtgaaaattcactaaaagccttccacaggaatttagctccagtattttggtgataattagtttataattagataggtttcaattaagcaaaatatttcacattctaacatgctgtcttgctaaacttgccagaaatgttgtctgcccatttgtttttttttctttttttgtttttgcatctatgcaatttttattaaattgatacatgagacccattagatataggacagacaggactgatttccccccaaaactatccatctattaaagaaaaataaattggaatatctcctggcacatgtgttagtctttctgtagaaaaaggttgttttagaaaggtaagcacatttccactccatttcaccctacacttccaatcctatccatccagttaccgggcaaacagacttgggaggctgtgtttatcatcaaaatcaaaagatgacagtaaggttagatagaaaacattcccctcaagcaacataataaacaatgagaagtaactatacctagtttggatatataaagtcctgcatcgccctgccccatatcagcatttacatccagtctaattattttctcttggttcattatattccataggactctccatttcaagtgacaaaactgtactggcttaatgaaaagtgggactttattgcctcaggtaactgaaaagtcaaaggggtagtgtgagggtcgggccaaatccaggctctccaatgatgtcttcagtgatgtctcagtctcagttctgttttcttctctgatgggtttgtcttcagtattctcatgtatttgcaagagtttatgtctctggtaaaaatggcaattttcattaaactaacatctacatataccctattctagaatctgaatattaatagtaacttgagaaaaactcaagcatgctgactggagtcagtttcagtttaaattattatgacctcttccttgcctatctctccaacttcctcttgtgcatattggtatgtgtcccaggcatctcaaagtacatataaactcctgaagatgttgtgctatttataccttcgtagtatttgtgatgtttcctcaagccacagtgtccaatatctacttaccatgttggtgacttgcagatttcttcgaatcattccagatttagtttaagaattaccttctttataatcttcctacgattttttcggtggagaataccaccctccccctcttgtcctgtgaccttcacacatacctccattctagcaccaatgtttctgtattacaactatgatctgcatctctatctctctcactaaagagaaacgctatgaggaaatcacacttcagttttcttcatctccccaagctctatatcacagtgcttagcaaatggtatttttgttgttattgagtgaataatgagttggtgaatgagaatttcctcaagaaattatttagattttttttctaaataattctgtttttaaaatcattttctttaaatattttttctatgaaaaatagactccaaataaatctaagtttatacagttcatacaacttatgaaatttgtgatccctaatgattatccatttcattacaaagctctttatctcaaaccacagtaacttatattaagaagctataaccccaagtgcatagatatgctcaccaatgtgcaaatatctactattaatattatggcacatggtgaatagtatttaaaattgaacatcattggttccaggtcagtgatccagggatgttgtgaaatttgtatggaaatcctattttacactggatcttaaaagactttttaaaggatgaaagatatatgcatgaagatgtaaatattctttgagaaaaatgttctcaagacctatctcaactgccagtaacaatatgaaatacagacaattacaaattacatctttgacatttaggatgttgaccgtagtttcaggtgtttaaatgtctcaatcattttctttgttctttgaaatttgttatatgaaggctacctatggtaaggcatcttgaccattcattaatgaacacaagaatctcttaaaataaaaaaaagtcagaaaatacttcattatgctgcgctatttgcctctgcttctgcttctccattaaattgtaccaaaatcacattttccaattattcctgtgtcatttggcatttttacctgacaagtaaattgaggtcatcaggaagagtgaatctcaaaatctctgttgtttcagtgtagccacagtttgatatactgaattgtattgtttctggagaagtggcagaggagtagaagaaggcacagctatgaaatcactttctgaaaaaaaaaaaaaaagtatgatccctgctaagggtctctgcttcaacagaaatgatccatgaggtttgtttccattcagctgagaaatcagtaatcagcttacttgaatggaaaaaagaaactcttgctattctcttttatttctaatcttagagatacttttcctttgggtagatagcatcaaatattgaatgaatgtaaaagaaaaatatcagtataatactatgttgactatatttactttttttcaaagcctaggcagggatatttaggaaaaaaaatgacccacattattttctattaatttatttctgaataaattattatttctaatcttatatatattttcctttgagtagatagcatcaaatattgaatgaatgtaaaagaaagatatcagtataatactaagttgactatttttactttttttcaaagcctaggcagggatatttaggaaaaataaatttacccacattattttctattaatttacctctgtacatactgatttacaaaatacaaatatgtaagggaatgtaatgtaaaattacaacgtgtttaagcattactgttgacacacaaatcaagtaagaaaactgttctttagccaagggcattttatccttatatttagaatgtgatttttatctctttttcacaaacaatacacatatattaatacctatactatgtatggcttatactaatcccttgttatatagaaagttgaaacatattattctgccctcaagaggcttgtagtagagatgagtcaaaaaactgaaactctcaggaaatgaatcattttgataatttaagtttttggccagggtttaatcttagaagtattatttttataactttagaatagtttggaggcaaacgttttttaatcatgcatccccaaactcttgtcctttcaaataaaatatattggacttatctcagtattttctaattaatatcgaatgatcatatgaaggtatcgagttataaaacatagtgaattatttgatgctccttgaattttgtagggctatttgatcctaaactcctggctcctgactagtgtacactttggaatcttgtgtcagattttcagtttttccacctcttccatcagtctgactagcagtgtgcaattattttcaactctctctttgtagatgcctccccaacctatcttctaatctgttgcctactacactattttatgaacttggaaatcaataaatatatgtgaagtaaaactgtgaggtatcaaagctgttttatagtatgtggacctcagtcagatgcctttctagagaatcttttttatttgtttttgtcttgctttctatcgttcaactaaatcacataattgagactgctgtctagctgatttcaaatacatgtgataatatgggtacctgaactaagaaaatacagtgggagttggagagaatgagaaagaatctaagaaatactttaaaattataagggacaggactgatcaacttggaaggcgaaggagagaattggttgagggctgagtccaaggtttcttgcctgaacatctctgagaatgggacatgggaaagggatgattttactttctaggcaatgggaaatgttctcaatattttaaaatgttattatgaagaataattacatccatataacgtggatgtattgtgaagagatactgtggaaaggcaacctaatagcaaatgatgaaactagtctactcctgtggggctgaagcctcacagtaggctgtgtcactggtaatagaggcaggatgaaaaacttgactctggacttggagttgtaggaaaatgcaaaatcaaggataaccctatgcttttaaacccacgtggcccaaatgataacaatatcatctacaaagtcacaagtttatgttcatctagaagatatgtttcctcagctttcatttgtatctcatactcttctgtctgcatgagaatgtggtgttgaaaatgtgaagattaattaatctccattatgtgttgctaaatgcttataaagttaagccaattctgatttctatacatgatctgagaggagaattttcctgtattggttgtccataaactttaaaactaatttactgggtatcatcaattcatggctttgttgagatttgtgctatgtttaaagaaatcattctgttgaaatgatgaagacaatttatttcactgagcagcattttttgtgagatgctttatttaaaaattcatattaactactgtcttcaataactttaaaaatatgttcataacagaaaagagttaactttaaaaatctattccacagaaaatgacacagaatacaaataacagattttactttgaaatgtaaatataaactagaataatcttgattacagggagacaaaatcatatgcctccatagaagaaaattctttggttaaaaatagccaaattgcctttctccgacactttcctaaagatatgaaatctcttttttaagtatttagattccaagtaaagcatttcactttttttttctttagatggaaacaaaccacacttaataatgtcatcacaacttatgccaaacgctgttgctcagttacaattttgcaattctttttggataattgcttcctcttaaggaagtatacttcttcccaaatcatagaatgaaatatatcattttaatatatttatctttgtccaagaatacaagctaacaattaaacaaaggatcatttccaatcagtgagtcacaaataaattttattttacactatggatttcagagtggttctttttagggacaagtttgctttcaacagatgccacttatatgagtaaacgatacatttttctcctacaaaactaatgagaaggttctgctcaggattgaaaaaactgaatggataatgctatagacaagttttcataacagagacatttgtagctctactgtattttagtggaatccatttggcaggtaacttcatggtttgcttatttgtttctttaagtgtctatttaaataaaccaaactaatgagatctctagccaaggaggtgatcatcctgttcctcctcttacttcttccaacacattacattttcccaaattccctgtcagctcactcactgccagaggctgcttattcttttccaacaccattcagtttcccttttgtaacaataattacttctgtaatttcttattcagtgtctgtcttccccactgaactgaaaatccatgagcacagtaactgtgttttgttcatcactgtataccctgtgtctatgttagtgcctagcataaactagttgctcaataaatattaattgaatgaactaataaattcttaaccttagactcatatttctgagctttggtccactcaacttggtaaaatgtagcagtctgaattccctagtagcttctacctcccagaaagcattgtctccaagcacacagagtaattggatttttctgattagtgttgggtacactctcttcacgtacattgtatagctacactgatggtaaatcttccccacatatcaagggaagggtgggaatgtggattactcctgaacttttcttaccagaaccatccagtgcaaataattattcaacccactcactcaaaggaatatttattaccatgtaggctggacactgtattggtttcctaggactgttgaaacaaattgtcactaagtcaatggcttaaaacaatatatcacagctctggagaccaaaagcatgctccctccaaagtttctaagagagacttcttccttttctcttcttgcttctggtgtcttattctttggcttgtgggttgcataactcatctctgcctttgtctttacatgtgtctttacatggccttctcgtctttgtcttctccacttttctctctcataaggacacttgtcattggatatgggacaacctgtttaatccaggataatcaagtttcttaattacacctgcaaattccttttttgaggggagggggaaaggctgtcaccattcaccccactatggatatcatagtgaatatagttcctgctctcattgaatttgaaatcaaatgagaaagacagattataaaaagtaatttcaataaaatgtgatggttttattggtagaaatcttttaagggtcttggggaacatctgtctggggacctacccaaatctaaacaaccagaaaaaaaagtgcttcccaaatgataagatattcatggaggagtgattagaaattgaccagatattaagagtttggctcattcaaggacttggaagaaattcagtatgcttaaagaatgataagatgtatctgaagacatacgctagagccatttgtagacagctttgataacaaagttaagggccttgtagtttatgcctgagatgaagtcagagctctgtgatggaccaacactaatatgataaaacgcaaaaattatccccatcaggaccaagctcctgagtgtttttatttccatatggcaaatcttgttctttccactattttgttgcagcctgcatggataacacaatatcatagtacaattgctctgaaagattgtgacaagaatgtttaattcaacattatcattttacagacatgaaatcaagttcaagcaaggctatgattgttgtagggtaaccaaaaccgctagatctagttagttcttctgttaggaaaaatggtggtttaaagtactggcaattgcttgggcttggagatcggcaaaaagaagttggattgccggctttcccttgacaagatatgtaaccttgagaaagtaactgtttaaactaggaatgataatagtacctacctatcaagaccattgtgaagataattttgataatgaattgacgctcatagtttcctattaaataaataatgactgttgttcttgttgaagatgataatgttgatgaggtttttataatcatcccagcctcacaatctatagcattttactcccagtataatagtgtttcattaaatactcttattaggaaataagagtatttaacatatttattttctaataagagtatttaacacattttattctccacagaggagtgtttacagttcctaagtttaagaaacaattatgcaggaatatgcatttttcaaagggtcataacttaagattgttatccaattaaaattttaattaaaacaaagtttataaatgtaataacaagtgtgcagaaggagacatatttgtagaattagcagtttagtcagtaattatgtatgtaaaacaacaccattttttataacaaagtaatctgattttcaaaaggcacccaattacaaaatctccctctgaattttggactcaacaaattatagctacctaactactatgaaactatatgcccctgattcaaaattcttgaattatgctatttattttacagatacaacagtttttaagtaaataatgttttttgggtaaatgccatctgctttatcttcaaaaagataatgctttctagaacaactatttcttacatttttgttattcaataactttcagtgagaaaatatgacattttagagcacaacattcattcccatgatatcggtgctattttgaagattaggaaattcagtgaagacctaataaaaaaccttcagtacattatttattggataagatgcaactatttaacttgtctctgcacagattatgagtgaaaacttaacattgtagtacattgcttgaaaatgtcttgattaaatcatagtgactaagttctaattctaagatttaatacatttctcttactgaaaactgaacataaatgacttcaactcttttgtttttatttacattcagatttttttaaaagtctctaaagtgctgtgactggtttcttactgacttgacaatagtgttgaaggcttagacattctgttgtagatatgtcatttttatgagaatgctattactctggatatgaatttgcacataatatactgcatactcaattcccagaaaaagatctacttctgtggaagctgtaaaatactcaagtttaataaattattatgttagagacttctgcagtttgcttctcagttatatactttatttgatccaattttctccaatagctgataagattaatagatattatttattttcagtagtcaaaataaaaaacaagtttaatttaagttaaggaacattaagagactgattgatttggttttttatattattgatgattaactcaattattactacaagttatagtaacaaaaatggagaaatgagacaaaaccctgaaagactgaattctggtcatagttttatgtgggcttgggcaatttctttaatttttctgtgcttctgttttcttacctctattattgaggaattgcctattccactcattgaaaattatatttgattaaagcattattaatataaaaaattagaagtgctaataaattaatttaaatgatatatgttaaaagattcccagaagattagtaaaacatgcagctcatgtgcttttaagagacagttttatgaatgaaagaaggaacatgttgctaccatatataatctggtcttttcttcaaaaaaggaagcttttaaacatcatttttccaattattgctgattaaacatctaagcacccattatgtatatcctcgtgctgtggaggtgagaatccacaattttagtgtttgaattaagttctatgaagtataaagaacatcattcttaaaaggaattatacagtagtctttctactttgtgaaaacagatatcaaaacagtctataaagcctggtctattggccagtgtttaagaggaaatacagtgagcaattacataaaacaattctttagcctatctgctgatttagttttacagcacatacttaatcttaaaataaggggtactaagaattcatctactttattgatcttttttgaagaaagaggacaggtttatgttgtgggttatggccccaactcttcagccctgagtcaaaactcatttattttgggtttgcttcatacgtgtcaaatactgaaataaaggccaaatatactgagcttggcatccgttattgtattttctagtgtaaactaaattgtaaaatggttttaatagtgaaatgtcacccagggaaattttaatattgtatctctgtttcagcttctgacatggcagcagaacaaggacagattctcgtgatagccaccgccgctgttggcggattcactctcctcgtcatcctcactttattcttcttgatcactgggaggtaactgaaacataccatactatttccgagatttatgaataaccactctttttatacattgtgtattcaaatgcttttagatataacaaagcacacctgaggtcgagagggatcccagaagaatccactctgacagtgaaccatcattagttctctgtttcaacaggtccctgaatatggaaagatccgaagatgactaaagctgtttgaaagctatgaatgatgaatttatagtcaataagttactccatatttttcctttactataatcaaattacatcataaaaaataattttcttaaaaaatattttaatggaaagtcagaacaatttatagaaaaactctttataaacctagtgttatagaaatataatattttgtcaattaaatattgaaactgtctatgttagaattatattaattggttttataaatccaatatttctatacttcaaagtaatttgaataaaatataaactaacagtaaatttaacatagcaaaagacctaaatttgaatcctgactaactggtccaagtgcttcacccatcagaaccttagctttctatttttatacaggtttgatacaaaagtatattaaaaccatttaatgactttttaataaatagtatgaatcccataatccaggtgctgataatacagacgtgaatgaagataatatgtataaaattatatcaaagaataaatgttatttcttatttaatccatggtatttggccaggactttttccagaaatcacaatattttattctcagatcattctaacaagaagataaaatagtctatctagatatcaaaagaggcacaaaagaatacctcaacagattttttataatcagaaacacacatctactgcaatatttcactatcatgatttaaaactgcaaaaagaatgtcagccaaacagtacacaccaatgttgactccagctaaagtacaccaaccctgccagaaaacattggtacgtcagaaagagcagaaataataaacagcaccttcagtgaaccgaaaacactatttgtttttaaaactctgcttagggaccaacattttattaaaatttaatctacttaaaattacagaggtaattttaatacacatatgaaaaattgtctacaattttgacagcacaccaaaaagtatagaacttgacaagtactttgcatgtatcaaatgtgggtccctgacaaatatacaactgctattcagtaacagtgtattagatatagttgtaacaaacctccttttatagaatttaccgaggaaaaaagcagcatgaatattctaatgtggttgagttaaaaatgatgacttatttgtgaaattaagtggaaagaaggcactttacaactatgtttacttaagtttttcatgtatataaacagatatagtaatggtcttagaattaagagggagtatttgggggtctctagttttggggggtgattagctgatagaataatgccagctacagtaacaagggaaaaaaacagacatgaaagaatgcaggaaataatgataaattcatcttaatacaagtactaatttgggcacaacatgttgccaccatcaggcactgttgtccagcatcctcttaggacccttttcctttatttttagggcaaacctctgacagctaactgccatcatcagagctttgatatagctcatcttttatagaggacagaaagcaaattttggaatctctaaaccaattaaccattaggttgtagattaaatgttcaacactgcagcttatcaaacatggcctacaaaaacttgaatcactagccagaataaagtgattataaaaaataaacaaaacccctaaacatcctggtggaggtctaagttttctgagaaagattaaaattattcccatactattttggactctggcaaagagagggattacaagacagttatggttagagaaagagaaagagaaagagagaggaagggaagggaaggggaggggaggggaggggaggaagggaaggaagggagggaggaaaggaaggagagaaagagagagaggaagtttcagtgagggttaatggcgcaagtttaaaaaagaaaggaaaaaagaaaataaaagtattttgttgtatgtaaagtcacaatgacaatttggttaagaaaatcaaattgccactactttagcattgctacgtgtttagtaaactttattaggaaaatgttaaatagaagaataaaccttactgtatattccttaccctctataacattaatgctgcccatgcattttgaactggggtcactgatatctttataatactctaattatcatgaaggacaatctgctttggagcccagaaagtttatttagtttttaaagtacaatggcattccattgtactttaaggagctcttaactacaaagacacaaatttatcatgtaactatactgtgaaaaaataggtatgatggttgattttgattcagaaatatttttgttttccattttcaaagtttctttgaaggagggagtaatctccttttcttattattatactttaagttctagggtacatgtgcacacatatgtttatggagggagtaatttcttaaatgtgattttatttaacatcagtattacattatttacaatagaaaaaaatcctctggacgtttaaaagaaatttaataatgattcactatattgcaaaattggatacagttatatgtatcttgtagaacataagttaaggccttattttttcatagagtatttcagtaaacagtgatttaaatagcacatacacatgtggcaaagcatttcattaaggcatcagaaaatatttccttaacacataaatatgacaaacacaaaagaaaacatttcaatctttgcaggctaaataagtattgcctaataaacttgagagttgggctcaaatattatctttatttgggattcctggagcagaatagatataccacttcaaaggagaatttaatgatgaagaaaaatttgtgctaaattattttcagctttcagtttctatgtttgccaatttatatttcattagaaattgctttaacattccatgcaatgaagagaacaatttcaattacataaaatagaaaaaaaaatattttgaagtattgcttaagcactttggtaggggagcagtcattggaaaatattctatgaaaactgtaagacatttctgaataaatgctcaacttgccatagaattcgaggcaaaattcccattgaaagactgaattatgtaacacagacgtactttgtttagccattagaaatttgataaaccatcaaatcatatggatgttgaagaatttactcatattgaagaaatcttgagagcatggttatccagagggagactagaacatgcctctaccaaattccaaatattaaaaaataaaactgctgaaccatcctgctgtttagcagtgaaaatggaagacagttgtatacatttctgaaattctgactcaaaatgctttttttattttgacttttaattttctttttaccaactctagctattagtagtcatgtaagggatggttatggcagattattaaatattttctaagactcctatctttcgaatccatctacttaacagtattttattctagggctaatttcagtgtacataaaaaacctactatagaatattttcacgttataaagatattttaaaagtggtctttatgacaagaaatttgttcatagattatatgtattttaattggttttgcattgtatgcatcatacttcttaaaacaagtttttttttttaatctttttaaaagatgtcagtggtacataaaagccaagatgaagtcagaagagaagagaagaaaccacttacagaatgggcattgtaagtagcgcagggactttctttcattattttgtactgttccagcacttcaggagttcattcaaactgtatctattgagttgagaaaaaaagaaaaaaaaaatcacttccaacctttcagcattaagaattttcatctggtttccaggtttgttggtgaaagttgcacctgcttctcattaaataacattaccttgttcccaattctgcttgctggaaaacacaacagactgaatttgctaaaaataatagttgactgattttatcaagttatttaccactcacaatggctctaaaacatgagttgattttatctagtggaacattagacatagaaataaatattagggaatctttattccttcttgtagggactgtcttttaaatatataacaaatcaatttacaattcattaatactaaaaaagaatatcagctctttaactcttagaatatgtatgaaatccttgggctgactacaaggttatattcatttgagagatctattcccaagcaacctataattaccactatagctggtttgataactgacaacttctcctcctcaacatccacctccacctccacctccaaattgcaaactacttcagcaagacagtttttctattgtgagacactgaattaacaagaaagggatgttctctaattaaccacagtgtagagataatatgcaaggcaacttaactgttttatcttttatttcaaattgagcaaaagataataaaggacatttcaatctataccaccctccaggaaagggaaaggatttaagtgaggaacttttattttttattattattttttaagtataattagaatttttcttttttttctttctttttatttatttattttttttagtatttattgatcattcttggctgtttctcggagagggggatttggcagggtcataggacaatagtggagggaaggtcagcagataaacatgtgaacaagggttctctggttttcctaggcagaggaccctgcggccttccgcagtgtttgtgtccctgggtacttgagattagggagtggtgatgactcttaaccagcatgctgccttcaagcatctgtttaacaaagcacatcttgcaccgcccttaatccatttaaccctgagtggacacagcacatgtttcagagagcaaggggttgggggtaaggttatagattaacagcatcccaaggcagaagaatttttcttagtacagaacaaaatggagtctcctatgtctaattctttctacacagacacagtaacaatctgatctctctttcttttccccacatttcccccttttctatttgacaaaaccgccatcgtcatcatggcccgttctcaatgagctgttgggtacacctcccagacggggtggcggccgggcagaggggctcctcacttcccagatggggcggctgccgagcggagggactcctcacttctcagatggggcggccgggcagaggcgctcctcatatcccagacggggtggcagagcagaggcgctccccacatctcagacaatgggcggccgggcaaagacgctcctcacttcctagacgggatggcggccgggaagaggcgctcctcacttcccagactgggtggctgggcagaggggctcctcacatcccagatgatgggcggccaggcagagaggctcctcacttcccagacggggtggcagcggggcagaggctgcaatctcgacactttgggaggccaaggcaggtggctgggaggtggaggttgtagagagccgagatcacgccactgcactccagccgaacaatttcctcatgaagtactggaaaagacaacctttttctccattactatttggacttttagatcacgtacataaccaggaattgaataaataatgaatgttttcataaagagtatccgtcttggagggagattccagttgtagagatgtttcacttgtgcaaaatatccaacatagctattctgagaaggagtttctactccctgaaattttttgctgtgggttttatctgttcgcctttctccaaaataatacaggctttcctttgcagttaaaaatatttcagaggcaataaggaaggcacaaaccatagttccggttcttcctccggcgcggggctaagtgcaggcccgggggtccctagagccgccggggcgcggcgcgtccggcgctgggggactgttgggtcagaaagtcttcagggagcagctgttgcgccctccctaggcccgccgcttggagacgccccgccccctgccttcaacggccggcccggggcccgccccgcaccgccccggccccgccccctgtgaggaacttttatacagtaagtctgactcttactgcactggcagagctgagagaactgatatctggcatgggataacatggaaaggctgtaaacagattgcagaaacctggatccagacacctgggctgatgacttaacgcagggcaaccttaagattcactgcagggcatttagtactgctatgcagagggaaaaggtgctcctgaggcatttattatctgttttccaagaggtaggttagcataaaccaaaccagatgggcccagcatgaagcgatgaaaataactcgagacagccaaggaggtagaagaaagttaaccaactgatgtttaagaagacgttgataagtttaaattagtaaccaggtattcaaaattggaattcagtttggttgtttattttcctctttactacacatatgtttataagaaaaaaatgtgatatttactgatcttattctatagaaatgtgtaccaccttaaataattgaatagtttaatagttaaaaccacatatgagttaataaatgatgcttgttatctgtgcctagcataatattatcaacatgaccacagatctgattagatatcactaataattagtagtggctactaggtttgaggttatagaactcagtctgaaatcacaaattctactaagttgttatgaaaatatcatatggaatataaaatagaggtacaaactatctgttctcattttcttcaatggatgctttgagaagtcaaggaaagcatgacatgttaaaattagtgtcaggtctgggtatacctggaaatatgcttttctggtgctaatttgagaaatattaattttctcacggtccatatgcagcactaagaagacagaagacaaaatgtgtaaatgaaggcaatgggcatagaaggactaaggaagcaaattgctgctaatattgggcatttcagcacctcctctaaactttattaccttttgtttgtttgtttttgatttttttgtttatatgttttgcaaggagagtcaaacaacagttaacgctgggtattataagactttcaaaatctaagaagcaacaaaaccaaataccatccactctgccacaaatttcacattggtcttttaatccctactagtttgtattcaataaaggctctctgtgtgattattgcctgtaaaaccatacctaagatattcggaacgatagaaagatatataagaaatgacctcctgtctagagatctaaaatggaaaatggaaattaatgagccagcttggtggcttgtgcctgtactcccagctactcaggaggccgaggcaggaggatcacttgagctcaagaattcaaggccagcctggacaacatagcaagactgccatttctctaaaaaaagcagagaaataaataaatgatcaaaacagagggatattcatgggcagaggcagtctatgacttcttcggatactcacaaatggacatacaaccacacattaatgttttctagccatcctttctcatcatcctaactgcctgtaggctgtgagccctccattctcaccaatgaagctcagcagatacacaaccaatgaccagattttggcctttgatttccatccttcccaccaggatagacaagctgatcctattcaggactatatgcagtcagtccatggaagccactacatgaatacaaaaaatggccattatccctactggcctttcttgtttctatgccatgaagtcagttctttactgcttgaggttttctggaaaagggggagaccacaggaatagggcatgagttcatgaaacctagtgccgtagagtacaaagagtccaggaggaacctagtgggcttccttgctttggagggaggcttatgcctcattttccccattccccaagctagagcagatgtggaatgttttggaagcatagtgaatgagtgagctgattaaacattttatagaaatatgagacatgtgttttctggaacctgtcagctcactttctagaaatccaccaggtcattctacattaacagtgaggtaaataaatttttgaccctcgtagtcaaagctttaatatgggacaggaagaaaagagagactttaaatcattatcaagactgactacttcagtatgtcatttccggttttaaatgttcacaagatatagaccactgagatactcaaactaaatcaatcgttttgttattgttgttgcagtgcgcttcccgggaattaaaacttacattgatccagatacatatgaagacccatccctagcagtccatgaatttgcaaaggagattgatccctcaagaattcgtattgagagagtcattggggcaggtaaatgtcaaatctacacttttgaacaaaacattccttaatttctttgtaactggtttatcaacatactatcttaaatcttggcagttttggtcattgaaaagttttaacaagtgagaagtaaagtgatcttgtatatgttattttttttaagtatatttagtgtccatttgtttccaaacaatgacaacattcacaaaagttacttttaacattctatagtctttttttatagtagagataaattacaatgaaactataatttttaggggtttgtcataaggttatagatttacttgagcgccaacatgtatagacatacactataattataatagtatttaaaatgatgaccatgagcctctgcaagacacagaaaagttctgagaatcaccaaagataaaatttggttcaatgtagttttaggtcattttaatgcaaattaatatttctccctatgtagaattttccaatcttagaacattttattattcaactatcctgaataaatacaaatttcttgtaaatcaccccacaggaatttatgctgtacattagttaaggcagaggctaagccaatgtaacaaacagactccagaatacagatttattcctctttcagatgcttgacccaaggtgaatagtccatgctggcagaggagctgtcattcagggggacttgcaaggcccaagttccttctgttcttggctcttccttcccctagcatgccatcctcctgtaaatgaccaaagctgggtcaccagtacatctgccttcctgactgtgagaaggaaaaggaaatagttctgtctctctggttttgcttttaaggcaatcacctgaaacttccaaacacagtattcacatctcaatggtccaaataacaataacatggacatacttaattgctagagagtttggaaacggaattgccgacagctgccatgcatgcagctaaaatgcatacatttatgcaggggggctgttttcctaaaatagacaagggatattggatcttgatggggaacataggtctcctctagatgctggagatttgtttaatcctttggaaagagcagaacagatgcaagcatggccattccagccaggtgtcatgtctttacaaaggccaaaagaaagcagctgatgatcctctgtttctttcaaagtcctttttcctccagaaggacaagctacataatttgcagggcccagtataccctgaaatatacagagtcccttgttaaaaatttattagttatttcaagacggtgacaacagagaactaaaccaactacagggcacacctaaactcaaggctgtacgtgactgcacaagttacatactcatgaagctaatcctgtttcccgggtacacagagaagtagaactacctcaagaattccaggcacatttgcagagagttcttcctgatttcactccattccctaggtaccatagatcacctcatctcctgcatggctgggtctccctctgaaagctgccacaagggcctttatgttcataatctttatgttctcagccaaagaagctgccttatcagaaagattaaggacctgaaatggaaccagattctctgtcttcttccactgaacaaagagcacatcagcaggcataactgagaagagtgattgaattatattcatttagctttggagtttgttttcttaagacagcaaagggatagagaagagaggaggttggataatctccattgcacacgatgtttggctttcttcttcttgcacctgtgaaaaactgatatgtctttttatactgccttgtccaatactcacatagatacaggagaagcattttctgttttagccctttgtgctacagcataacaaaatgccagtgtctgaaatcataatgttgagagataaaatcaagtattgaagtataaacaataagaagaaataaaatgtttcttttatttttagatattttttcaagtaaaatataaattgttctcttaaaaaagtataattgatactgcaaaagcaaaaaataactactaaagagattattttaatttcatttttccacctgctgtccctgaactctaataagtcataatggcgtttatctcatttggcaaagacagattatctaaaccatgtagttattcctatagattggggtctctttttaaatctttattcatctttgattgtttcagctttcaaacaatatgctaagggtccttttactgtccatattcagaaaaataacaaaaataaaactggtatgtgagacaaaagtattataacctaacttgcgcccctggccgtactgctctgttaatttattcctttagatcattgttatagccctttttatgctgctctaatagaatgcctcacatggggtagtttataatgaacagagtttttaggctcaaggtcctggcggctgaagtcaagattgaggggccacatctgctgagggtcttcctgctgcatcataacatggtggaaggcatcacatgggtgagggagagaaaaagggggctgacctctcccttttatgaggctgctgcattaatccagtcatgagggctgagccctcatgatctaattacctctttaaggtcccacctctaaacacagttgtattaaggattaagtttccagtgtgtgcacttgaggggacacattcaaaccatagcagtcatgtttctaaaactttacttttgtgactgtgtgaagtgtgaacgtattccatagcagcagtgtggacaaaacattgctcaaattgaagaagaaccagtcgtgtaacatctgtgtaccactggttactttcccaatttgtaactataaatattttcttacattgttttgtatcctttattttctttccccagctattgattgtttcttctgggactctatttcttcatcatctttgtctgttaggtagtccccttggaaatgtaaattaagtgacttaagtggtagtctagatgctagacagaggtgaagtgaggtagagaagatgagagaggccagatatcaggttgtgacaattgtcaagtgcaggatattcaggcagaattaaggcattgacagtaggaatggcaaggagtacttagattcacagttcatttctgaggaaaaatgtacgagacctctgtctcttatagatgcaagacatgcatgcaaagcaacagttaagattacttttcagatttctagttggaaaagcacaatatacaatcattaaatctttcttaaatgagttatcagaaataaatgtaaaacagccacattaacattttcacaaaaagcatgatatcacacctgacctgtgacatttcttaccacattcactgaacaatgtttgttagatggctaatatttacttgtaaaagataatgtgccacttaatcatttcatattaaatcactatgctcattagagatacatgtattcaggctgtcttcctcaatctttgtcctgagattttcaactactaaccatcaaaatactgtgcaactgaaccataaaaatttaatttttctgtacatatattcttaacattctccttctttccctataaatttcactggttttttataagttttctagggtactttttttgtgtgtgtatcactgttctatttaatactggcagcttatctttgttcatcaatattggcctgaatttccatgaaaatgcacatttccatttaaatgaagtgagcagctctgttgcataggagactatcaagatcatctatctcctttggcttttttgcactataaaatgaaattctgtggacagaggactgtaaaacagaaactcccaggctaaaacagccaggtcagattaggggagaatcattattttatacatatcttgcaagatatgagaaaacggtaaacaattttaatcatggtctgaaaaagtcattgaaaggttgtccctctttcagggtactactaaacctaaaccagtataagaacaacttgcctggcagagtataattttgaaacattattccattgaaaaaatgattcttgtgtcgctaagcccatagggcacccttcttaaatttgaccttccctgtttcccttgtctcaatggaaatacataatatcttcctgtcatacatattctttccctttatctatatgaaactcattatggcctccactatcagccttctcttctggcttagagtcaccaaattttttctctttctagaatagtccaggaagttttaactgttggtttctcagcagttatctgcaggtaaaagaatgtcaaaaggacaacaagaaggatataaaagtgagtgtcaagcctaatatttcgattctgttattccgtcttgtttgaaatcacatttccccttgatgctatacaaggcctaatgttcacttcatgtgcctctcctaattcccctgccaccctcaacccagcaggcctctattttctactctagaatatattattttttagttatcttaaagaaactgtatttttgtttgtcttttacacttgtgttatatattcttgtagcatgacaatgacaaatgtaggcaatattccagatgtggtttcacaattctctttatatatatattttaaaaccttgtgtttatggctcattttctctatatttagatgagatgacttccttagaaatgagattcattcttgtccatcaacttaaaggatttatggtagaggtcacattcattttcttgtgtattcttgaaaactttgcatgttgagtagactgagaataagatcaacaacagattttggcaaggcctttgtgcttttactcaataatttcagagctttctaaatcaaatgatgtaataaaagatcagctttacccattctccatctatattatgatatgaatgaaaaagcaaagaatgaagcaagacagactcagatatgaatcacagctttgctactagctcattctgtaaactttaacaatttagttatcgttcagaaatttgggtcactccatgtataaagtagatttataataacagctatcttacaggattaataaaaggattagaaatgactattagattaaaaaataaatacagtttctacattcagttttgactgctgagatgaataacacttattgcccaaccctcaatatactttgtgatacgaatatctgcccatgcagaattcaacagtcaatgccttaggtaactggaataatatttatgattttcagagttagttgaaaattagtaattgaaatgaaattttatttttgttactacattgagttatatccatgtcaacaaactctttttctttttaattaaagaaactcaaggcagggcacggtgactcacgcctgtaatcccagcatgttgggaggcccaggcgggtggatcacgaggtcaggagatcaagacaatcttggctaacacggtgaaaccctgtctctactaaaaaacacaaaaaattagcagggcgttgtggcgggtgcctgtagtcccagctactccggaggctgaggcaagagaatggcatgaacccgggaggcagagcttgcagtgagcccgagatcgcaccactgcactccagcctgggcgaaaaagcgagaccccgtcttaaaaaaaaaaaaaaaagaaactcaaaacttattttttttatatttaggaggttatatttgtcagggaatgtttattttttgttaaaaaactcaacaagtcttaagatgagaatcaaaggaaaaattatttaaattcttaacgtaaaactattctacagtagtctatcaatttattcttggtacatctaaggaattagtagatttactgtcaggagcaggactgtatatcaatttaatagactttcaattaatttttgttaatttcatgagtgtttacctgcatttcaacaccgtacatcttatttggaaccatttagtacacattttctatcttatatacagatttccaaaacttgcaagttgcctcatcatagtcattgtttgataaatgcttgtttaataaataaataaaattcttaaactaatttaaaaaaataatgagtaaataaatgaatgacaaaaggatatagaattattctaagtaatgattttacgtgactatgtttatctggttgccaacaaaaatcttaatgaagtatgacaatataaaattaattgcataatatgtgcaaataaaaataagaaaaattcatagaggacatttgggaattacaattgttacattgctttatattaacaatttacttgatagaccaaaattatagaatttattatatgcctttgcacttatatagtaaaatacagaattatacagaaaatattacattgatattttattttgaattgagtttatgtaacaggggaagtaattttgaagagttgtttataacttacaaagaagttatttttcaaatttgtttttatttttttcttctagtttgtgtattgctaaaatattaggtgaaatgaaggaaatttgatccctattttcaaaagagttctccaaggatgttagcaagactgggtacatcttagaatgatgttctttcttatggctaagaaacaatagatgagaaagacccacatatcgacagcaacaacttttagcccttatatttctagagtatattagttatctcttgctgcacaacaaattaccctaaaacttaaaacaggaacattactatctcacagtgtcagtggctcaggattcaggaatggcttagctcctgcacagttgctcacaaggttgcagtcctggtgtcagctgggactgtggtctcaactgaaggtcagctgggcaaggatccacatccaaacttatttatatagctgctgtcaggatacagtcctttgagggttgttgcacagacagttttaattcctcactgctgttggctggagaacatcctcagattcttaccatgtgggcatctccaacgtggcagcttgcttcatcaaagccagcaacagagtctgctagtaagacagaagtcacagtgttttataacctaatcatggaagtgacagcaaattacctttgcacattctattgaccataaatatgatactagaccctccccacactgaagggaagggatcacacaaggacaggaataccaggatgcagggatcattgcaggccatcttaaaagtttgcctactacaaatagtattgtttcattatgtttggggctctaaggtggtcctaattagccagcattaccaggagtgatttctccccttcagtccaattcacatcaaagatatcaaagatgagtcttagacactctctgatactcaagcagtttattctggcagtgctcttgtaagatggatagtggggagcaggccagtggcatgggccaggtacagtcggggggtcagatgatcaactgaccaggagggtctctgtctggagaccattctcagagtttaggaagttcctcccactttcttatacctgtattcagtgtgggtcaattattaggtgtttctttcataaagggagtgtagtctctccttgtaagggtatgctttttttttttttttaaggtttatgagagttgaatctgtgctgagatggccttgtgtatagggtatccagggtttttaggtctcattgtcatagagacccagtcatccccaggcctacttgcatcatacccctaaggacacataatgtcggccctgtgagttgtttgagtaggccatagggctgtcattaatcccacagccaccatgtgtttgtaggcagtgtttcaagcagagagcaagagttgtaaggccacttgaggtcttgtctctgaacttaattctgacacatacagttgatcaaagcaagtcacaaagccagaccatatttaacaaggtagaaaaatagattttactggtcaatgggaacagcaaaattacattgcaaagtggcatacatgtaggatagggaggaattcatggccatttttttacaatctaccacatagctgatagatttttttaagtgaatcattattttttcaagcttaaagtgaataacagattatgaattcatttgctattttgtctctaagactatttttgctttgcaccccctaatgaatgatattaatgttttcttaatactcttagttaatcagccttgggttaggtattaataggcttacaaaaaggaataatgagctgggcatggtggctcacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaaaagcattagaagtggtagaataaatggtgtggagattaagaggaatttaggacgttttcaagtatttagagcttgatgacactgggatctttattatatctaatttctcttcaaaacataagcttttcctttttttttttttttttgatgtgaatgtaactctagccctgctttttggctatgaataatggctagtgactttttagtttgttgactttttaatgacaaagtttaaagtgattaaagaaaagaggaaagatgttttacttttattgggcaaagaaaagtaaaaaagagtatggatctgtatgtgtgtgtgtatgtatacatacgtacatgtaaatgtgtttgtgtttgtatgtgtgtgtgtgtgtatacatacgtacatgtaaatgtgtttgtgtttgtatgtgtgtgtgtgtatgtgtgtattagtcagcttcactgtcataacaaaatatcacagattgggtggcttaaaaggcacaaatttattttctcacagttctggaggctggagttttagatggggtgcctacatggtcaggttctggagaagctgtcttctggatcgcagagatccacctccttgtcctcacatggcagagaagagatatatcttcctcttcgtataagatcacagtctttatcagattagggtcccgctctgaaaacctcatttagccttaatttcttccaaaagaccatatgtccagatgctgtcacattgagttagagtatcaatgtataaattttggggggacacaatttagtcctctgtgtgtgtgtgtgtgtgtagtgggtgaggaagaaagcaagatattacctgatgaaagatttactcactgttatccaagtgtcttcatgagtaaattttgaatgaaagaataaaaattgtaaattcataaaggatatgcctgctaggtttgacttactgggagagctctgtctgaacttagagctgagtttaggctgagagctaaagcaaactatctcgtggttaccacgtgtccagagagtggtggaggcacagggaaacagagagaggagcaataggtctcccagagtaaaatctataaagatggtacaatttcagttacttttcagataatatgctgatgtgattgctgttaagactataagaaagatttcaaaaaatcaatatgaatgctaaaaatcaaactgttcaatgtgcaattgaagcctaagtgctttgaccaggatgtacctattatgggttatctttgtagtaggttcttccaacagatgttagaaccttttctaaaatcaggtatttgacattttatcacaacttttattaacatcaatgtaacttgtgtatccactgttccctgattataatggaaaagtaccttaattttatccggaaataatatttgtgtcataaatagggtttcttccccaaaagttatttccgccttttataaccagttaatctatctctggttagaatcttataaactttcctcgcagtaagtgacactttctaacctgtctcgtctttacctgatcttgtccctaaaatttggagtcattttatatttgttcttcaaacatctcatccactgggggagaaaattcaatttaaattttgagaacaagaactagccaatttaccttcgtgagctgtaatttccctatccgtgaaataaaagtaaaatacctttactccttcatgattgttgtgagaagaaaatgagataaagtagattctatctgaccatccagcatttatcagaacaccaccagtgaaagtgttcactacctccaagatagcccattcccttgggaacagttccaataaatccaggatatttgtgagtaaaaaaaaaaagtgcttccttataactccgtacatgatcttacaacactgcctactggtactcgttctgcaaaattgaacttatacaaagtaaacctaatcctacttccacaccacaccattacccttcaaatagttaaagaacaacatgtaaacctcataaatcttctttgttcagcctaaattgtctaaatcttttcaaccatttccatccgacatgatgtctagatacgtcatcattctggccaccttcctctggagatctagagtttttctctaagtcttttccagaattgaacccaatactccaaatgttttctaatcaatgtgagaacacagggatagcacgtttcctgctgtgcctcgattaatgcatcctgagtttgcatttgctttttgaacagctgccacgcgctgttggcatagggagagcttactaccagcttatccccagcggtctttctcagaggagtttctattaagccaggcctatttctatacttgtcaattgactttattacttttgagtgcaatattatatttttataggtctacactatatatatatgtaaatcatatatataaatatgaaccatatatatcatataattcatatataaaaatatgaatagatatagatatgttgaaaatggtctagatatgtaatacctatataaatttgtatagataggtaaagaatgtatattctagaaatatatactagaatatatgatatattctttacatgtctatacaaattctagtatatatagaatatatgatatggaatatatggtatatgtactttacatctctatacaaacattatgtacttttcatattcccatttcataaatattcctattcaatttcattgtgtttctgtaagtaaaatttctcaacctgtccatgtctttttccatctcaattacatcagctggtacaattattgtccttctcagtaacatctgtgatttgttctgccttgcaatttagctgtgtactcttatcataagagctcagcactccctgtgcagcaatcatttagtatactctctaattttcttcttcattggtacaattgttttttcattattggaattctgtattttgtagttgcctatctctcactctttatagaatctctgatcaagaaattgtacccaatccatgtgcattttttaactgccactctgaagtttaatgtctacagttatggccgtactttttccctggactgtaaatatcttaaagtgaaaatggtcagttttttcccaggtttccccaccccttgcatttcatcagtctttattcagaactaaatcaaaataacagctctgttgactttttgaaagacggacacagcagcgaggcaggcaattatgattttatagcttctctcttattgctttcatggtggactaaatgaattcacagcatgggaaagtgtgttttgtgaggattgattgaagtgtgaagcacatggactttccatgtggtctaatgcagttccttgttcacatggaaagctctgatattctcttcctgccaaaatctttgtccgtggtttcctcctcgcttcagcctatcaggaaaaaaaagtctgtctttaccattaatagtaggcaagaattattaaatgttcatctgcttgggatgagctttacatgcattattatttcttttatcatcacaaacctataaatcacaaggatcacatatgtctattttacagatacgaaagctaagatttaaagagattaagttatttggtcaaagtgaaccagcttgtaatagtgaagccagagtaatcttatgttatagctcatgcttttattaaccacaacttcattacaaataaccctttatatttatgaagccatacttctataagaatatcttcttctggcacttgtacaactgataattctgaaaccatcttcacctatcttaggtgaatttggctgtgttccttgctttcattctggccatctgtcagtctttctgtctgtagtcactttccaactctatgacgtatagactgtgttttagctgctgattgagtctctgtgatttgtaggctgaaagtgaattaccattacctaagtgcattgatgcacacacacaaaaaaaaaaccaactgcctcagcagaaccaacagtaatgtgaatattgattattgtcatgaaatcattatttaggataggattacaaatttccctcatttgtagtgagatttgcatgttctgtgtggcatgtcaatttatcatcattccctgtcagctctgccttcaaatatatcccaggatccaacctcgttttaccactttgcaacagcctccctggccaacccaccaacacctctcctagcctcccttcttctaccactccgtggtatgttctcctaacatggaaccctagaatggaaagatcccttggaaatgtaaaccagattgtgtccctctctgctcaaaacctgccaatcatgatctgttctggtcaaagtaaaagcctggccacctacttagctgcctcttcaattgcatctccaccaacctttccttcacgcattgctctggcaacaatggtgtcattcttcctcaactttctacatgcactcctatctcaagacctttgcacctggtattctgtctaactaggaagctcttagctccagtaacatcatggctctgtccccactccctcacttcctccaacttctatgacaatgcaaatttatcagagacctttcaggtccttcataaactagcaattctcctttcttactctccttccctctcaccctgcctttattccacagtaattattaccaactaacatgtacatgtgttttgtttttcctattgtctgtcttccctttctctttctaattcactgctgtaccctcagccctttaaacactacttggcatgtggtaggcactatataaattttaattaatggatatagaatttacaagtgtttatttatctattaaatgactttattctcaaaaacctagtgtagggttgaggagaagggagcaggatcataattcttcttatgcatgtgcggggttaattgctgtgatggaatgctgaaaagaatgcatcagactctcagaaaaaaaaaagcaggcaagtctaattgaattttaggagaattacatagattgcaattaaaatgatcactataatgtcagtgtggaggaaggatttagataagcagtgattgacagcagataaacccataagaattcagggattcatgagaacaaggcaacagaacaagtctcaggttttttaccagaatgactgaggttaaaacaaacaaacaaacaaaaaaacacaggaatattgggatatttgacatgttgagataatgtggaagaatcaagtgttttcaagccaagaatgaaaatctggtctatgttcttgtttgacgaaaatcactatgctcttgatgtattaaataacccttctttaccccgttatctataattcctatgaagacaaggaatgaacttagattataactgattggttgtaacgtagagctctgcctagtgagaagcaaatccaagagacacaattgtccagtttctaaatgtgcatagccaaagaaaagccaaaagaaaatagcaaaaaaaaaaaaaaaaaaaatggagtctgtcccaaagcaggcaggaatgtcttgcttgccagagttgtacgtcaagtccaggaggcttttttcagctcgttgttgggtcatgggcccagtgaaataatgggccattacctgactaaggagaaaaaaataaaggggtagggaagagagttaaattttatttttaaaacagtaaatttgaaagtacaattagtgtgaatgttgtcttatatttgatgtattggcctggtaagggtcacttgttggttgatggaacaaatgtttatagtactggagatcagtggttcctttttcctttactctataacagtggtcctcaacccccaggctgtgggcttcacccacctcctgtcagatcagtggtgacattagactctcataggagaacaaaccctattgtgaatgtgcatgtgagggacctaggttgcgtgctccttatgagaatctaatgcctgatgatctgaaatagaacagattcatcctgaagctatcctcccccaacccttcatctgcggaaaaattgtcttccatgaaaccagttgctcatgccaaaaaggttggggacctccactctataagatctaactgcactttgcaaaagcaataatcaaaagaattgaaggatgacagatttccattacgattatagaaacttttaatttatttctgtctttttaaaacttttaagctttaagtcaaaataatgtacacatatatctttagaaaagatatacaaactagaagggcatataatgaaaagcacaaggatgccatgccttctctttactccccatccaacctcgattcttgttcatctgtggcaatgatttttacctgattctgttttttaattatgaattaaacgttacttattgactttctgttatcatggataaagatatagcttccttacagcacccacatctcctttcctctcaatataattgttgcctttataactgatgataccttcataacttaaacattaagatctgtatatcttcttcccacaaatatagtcactatgttttatactttggtagtttcttacctataatcaagatacaaaacatacaaacagcatattttcaaattattatacagtcttgtgccacttaagaacaaggatatgctctgagaaatgcattattagattatttcattgtggtacaaacatcatagagtgcacttaacccaaacctagatggcagcatctattgtacgctgaagctatatggtatagcctattccttctaggctacaaagctgtaaagcatactgcactgaataccttaggcaattgtaacacaatggcaagtatttgtgtatctaaacataacatcaaaaaggtatagtaaaaatgcagcataaaaatgtggtataaaagtgccctacctgtgtagggcacttatcgtgaatgaagcttgaaggactagaagttgctctggataagtcagtgagtgagtaaggtgtgaatgtgaaggcctagtacattcctgtacactactgtatgtaaactttataaacactgtacacttagactacactaaatgtataaaatacaaatattttttcttcaataataaattttattttataaactttttaacttttttaacttcttgactataataacactcagaataaagcacgaacacattgtacagctgtataaaagattatccttatttatattcttattctataagctttttcctgtgtaaattttgtttttaatttttaaattgttttgttacaaactaaaacacaaacatacacatgagcttaggtctacacaagatcaggatcacaaatattgctgtcttccacctccacatcttttgtcacactggaaggtcttttgggatgtggtatgtgtaagttcattctgacattcctagaaatacctgagactggataattttattttttttttaaaaaaagaggtttaattgggttaaaattcgacaggttgtacaggaagcacgatgctgacacctgctcagcttctggggaagactcaggaaatatatagtaatggtggaaggtgaagggggagcaggcatgtcacatggcaggagaggagcaaaatagagagtggaggggcaggtgctacatacttgtaaacgaccagatctcgctattatgagaacagcaccagggggatagtgctaaaccattcatgagaaatccacccacataacccaatcattttccatcaggcccggcctacaacactggggattataattcaccatgagatctggatggagagacagatccaaaccatatcatggtagtagatattatgaagaagagtgtgtttgtctcctgctaaggttccaaaatgacagctatcttctggatatacctgaattaattaattctattattatcaatggctcatttaaacaagcttgaaacccctagtatcttttttagtttcataattaatcagttcaataaggagtatagttaaattaatttctgtaaaacctttaaaatggtagctaattcttggctactattatcttcatataataggaagccataagtaaaagtatacaacaaatagcaattttttttctagttctaaagtactatgcccaagctcaaagggttacctactcttcgtaatattttcataattttgaaaccaacacttactatttgggataacagttctggactttagtttcctgtacctctcaaaaatgaggtatataagaacatattcaaaaaatgtaaaataaaacttgatggtcacagtacaaccagaaattgagaaatctgccaataaggcagaagttttgatgtgctttctttaataacttctattacccaaggaataaattgagtaaagctggaggatctgaatgatacaacttaaaaaattctatctgatgaatatatagagattgagtaaagctggaagatctgaatgatacaatttaaaaattctatcttatgaatatatagaaacaataataaactcaaatttgcagaataatattccctttaagcagacaaaaaaatataattgatcatgttccaggtcataaagaaatttgtaacaaattttaaaggctgagatttttatagaatacatttctaaacaaaattaagttagaaataaataatagaacagtaactttaaaaaacagagaatttaaaatattttaaaataacacatgaattgttttcaaagtaattaaataactcacttaaataactcatgggttattttaatataatttagaaaatttctagacctaaataatagtgaaaaaaactacatcttaaaacttacagggcacaactaatgtgatactttagaagtaaatgtatctagccttaaaatgcttattttagaaacaaagaaatgatgaatattaaagagctaagaatccagcttaacaatttagaaaaagagaaagggaataaaagaaagtagaaggaaagaaatggtaaagataagatcaaaaacagtaaatggtggtcaagggtgcacaggcttatgcaaacccacccccaaattctgagagagatgagaggctgaagaaagaggctggcaagtccagtttctcagaaaggaatatttaatggagacttacaagtagaggccatgtctgtgccttccatggagacaagacaagatgatggatcctcacgacattaccccctatacccagggcttacgtaccacagagaaagagtatttgcgattcagaagagatatgtaggacaattggagcatgataacattgaggctgttttgacctaagagcaagatttacagtaactacctgctttttttttttttttttttttgacagaatcttgctctatcgcccacgctggagtgcaatggtgcaatctcggctcactgcaacctctgcctcctaggttcaagtgtttctcctgcctcagcctcccaagtagctgggactacaggtgcacaccatcacatctggttaatttttgtatttttagtagagatggggtttcaccacgttgggcaggctggtctcaaactcctgacctcagatgatccacccacctcggcctcctaaagtgctgggattatacatgtgagccaccgtgcccgggcaagtacctgctcttatacaagaaacaataaaactggaaattttagtggccttcccagaatacacattaatcaaaagtcaatatgggctgggtgtggtgtcacgcctgtaatcctagcactttgggagaccaagatgggaggatcacgaggtcaggagatcgagaccatcctggccaacatggtnnnnnnnnnnnnnnnnnnnnnnnnnnnnnnnnnnnnnnnnnnnnnnnnnnaccaagatgggaggatcacgaggtcaggagatcgagaccatcctggccaacatggtgaaaccccgtctctactaaaatacaaaaaaattagctgggcatggtggcatgcacctgtagtcccagccacttgggaggctgagggaggggaatcacttgaaccagcgaggtggaggttgcagtgagccgagattgtgtcattacgctccaggctggtaaaagagcaagactctgtctcaaaaaaaaaaaaaaaaaaaaaaaaaaaaaagtcaacatagtggattattatgcaggatggatttgctttagtcttcacaaatagaaaacaaaataacaagaaaactaaaatttgtttccttaaaatactaataaaattttcaaactaactctgacaaaacaaatcaagaaaaatataaggtataagtgaacaatattacagatgaaaaaggaaaagaagatataactgctgataaaaatatttaaaaatcaataggaaaatactataaacagctttgttacaataaatgtaaaaattagataaaagagacaagtttttggaaaattatatattacaaaaactgacctcaggataaataggaaactaaattgtcctatattcattacataaattgtgtcagtgtttttccctgcaaaggaaatttcagatccagattttgagtttttttgaaagttttacggaacacatagttccaaaaaacagataaatccaattttacacaaattcaaataatattaaaattttgctccctaggtaaaactgtgagctgaaaaagtttgtttgacttaccattctccctcctaaagcataaactatttacctaatattacctaagcctctttttctgctcagttaggaactagtcctttccttctaccctgcaccaaaacacaaagcatgcaccaaagcttgaagtcactttggaaaataactggtactaaacagtcagaatgctgttattgctggaaatcaacctgtaatgatgagatttcagtgtgtcatagtaaactggagacatatttgggagatatttcactttcacattcaaacactgagataagtcactaattttgtcgccattcccctatattagagttttacagtctgatggcattaatgactgtccaaattctcattttatgttaagtatgaattttaaaacatgtccttttaggaaatacttatttaaaaattcaaaagtttcattatgtttacatatatatttctaaattttataaaattttacttctttagttattactgcttttttataacaattggaagacttaaatttgataagtaaaggaaaatttcaacctccagaatgctgggaaatgaaaactctaaaacaattctatgctgtggagcatttagggttattctttcaatttccaggattttaagtattttatacagttgtttccaaaatgtgttatttacttttcataagctattaaaacagtagaagattaatctttttctaacatagcaaagaaaattcacaatagcaaaaactagaatgaagagatctcacttgctggccaaataattaatacaattgttacagtcttgccaatgcaccacaatgtagcagtctctcattgtgaagtgtcaggctggagttctttatctcaggaccaagagaattaaggagcctggacacaaaggctaaggttggagcaaaagttttaataagtgagagaagaaagagctctgcagtgggtagggggcccggaagtggaagtggttgccgtttttacagttgaatgcaaaggcttttataagaaaatgatgaggcctagcatctcatttgcataaggagcaaatttctgtcagctccaccccatcctcctagtgtgcatgtgggcccttagcttgagttactttatatagctttgtttcccttactgtatatgtgtcaggggacagagttttccattgcaggcatgtctgagcaagtcacctgtgtagcccttctttagccaagccacactgtgcaagttctctcatctgtgctttcaggctgttcttttgtttgaaaggattcaactgaggacccacctaaactgcctgcccgatggtatatttttcttcctcctctctcacaatctcattttggtgtatatccttctaatctatttcctaagcacaaagtttattttttattttcataaagttgaaattataccctatagtatttttacgtatatacttaacatacttttatattcactttctaatataacatgtacattttccatgttattacatgtagtataagttatctgaacaaatctgtttgtaaaaacttgaaatcaatcccaatttttttattatttataaacctgctttttaaaaatattttctttttttaatgcatacattattttatttgatctggttacatgaggttacctttgtcatccccagaattttatagaggaagttcaattcagtctgaatggcagtgtcctcataggtgtgtccaccaagtagagtggcaagggcgtagacttgctaaatcagtgactttagataagttgtataatctctttgaaattcaggtttctcatttcttttgttttattattattatactttaagttctgggatacatgtgcagaacatgcaagtttgctacatatgtatacatgtgctgtggtggtttgctgcacccatcaacccgtcatctacattaggtatttcttctaatgctatccctcccctagccccccacccccgacaggccctgatgtgtgatgtttgcctccctgtgtccttgtgatctcattgttcaactcccacttatgagtgagaacatgtggtgtttggttgtctgttcctgtgttagtttgctgagaatgatggtttccagcttcatccatgtccctgcaaaggacatgaactcatccttttttatggatgcatagtatttcatggtgtatatgtgccatgttttctttatccagtctgtcattgatgggcatttgggttggttctaagtctttgctattgtgaacagtgctgcaataaacatatgtgtgcaggtgtctttatagtagaatgatttatagtccgttgggcatatacccagtaatgggattgctgggtcaaatggtatttctggttctagatccttgaggaatcaccacactgtcttccacaatggttgaactaatttacaccatcaacagtgtaaaagtgttcctatttctccacatcctctccagcatctgttgtttcctgactttttaatgatcgccattctaactggcatgagataatatttcattgtggttttgatttgcatttctctgatggccagtggtgatgaactttttttcatgtgtttgtttggccacataaatgtcttcttttgagaagtgtctgttcatatcctttgcccacgttttgatggggttgtttttttctcgtaaatttgtttaagttctttgtagattctggatattagctctttgtcagatggatagattgcaaaaattttctcccattccataggttgcctgttcactctgatgatagtttctttgctgtgcacacactctttagtttaattagatcccatttgtctattttggcttttgttgccattgcttttggtgttttcgtcatgaagtctttgtgcatgcccacgtcctgaatggtattgcctaggttttcttctagagtttttatggttttaggtcttacatttaagtctttagtccatcttgagttaatttttgtataaagtgtaaggaaggggtccagtttcagttttctgcatatggctagccagttttcccaacaccatttattaaataggaaatcctttccccattgcttgtttttgtaaggcttgtcaaagaacagatggctgagattggtggagttagttctgagacctctgttctcttcagttggtctatatatctgttttggtaccagtaccatgctgttttggttactgtagccttgtagtatagtttgaagtcaggtagcatgatgcctaccagctttgttctttttggttaggattgtcttggctctacaggctcttttttaattccacgtagttgtttctaattctgtgaagaagtcaatggtagattgatggggataacatggaatctataaattactttgggcagtatggccattttcacgatattgattcttcctattcatgagcatggaatgtttttccatttgtttgtgtcctctcttatttccttgatcagtggtttgtagttctccttgaagaagtccttcacatcccctgtaagttgtattcctaggtattttattccctttgtagtcatgcgaggggaagttcactcatgatttttctctctgtctattattggtgtagaggaatgcttgtgatttttgcacattgattttgtatcctgggactttgctgaagttgcttatcatcttaaggagattttgagctgagatgatggggttttctaaatatacaatcatgtcatctgcaaacagagacagtttgacttcctctcttcctattgaataccctttattttttctcttgcctgaatgacctggccagaacttccaatactttgttgaataggagtggtgagagagggcatacttgtccttgtaccaattatcaatgggagtgcttccagcttttgcccattcactatgatattggctgtgggtttgtcataaatagctcttattattttgagatatgttccatcaatacctagtttattcagagtttttagcatgaaggagtgtcgaattttatcgaaggccttttctgcatctattaagatattcttgtggtttttgtcattggttttgtttatgtgatggattatattttttgatttgcatatattaaaccagccttgcatcccaggggtgaagctgacttaatcgtggtggataagctttttgatatgctggcagatcgttttgccagtattttattgaggatttttgcattgatgttcatcagggatattggtctgaaattttctttttttgttgtgtctgcctggtttgggtatcaggatgatgctggcctcttaaaatgacttagggaggagtccctcttttttctgttgtttggaacagctttagaaggaatggtaccagctcctctttgtacctctggtagaatttggctgtgaatctgtctggtcctgggctttttttttgataggctattaattactgcctgaatttcagaacttgttattgatctattcagggattcgacttcttcctggtttagccttgggagggtgtacgtgtccaggaatttatccatttcttctaggttttctagtttattggtgtagaggcatttatagtattctctgatggtagtttgtattctgtgggctcagtggtgatatctactttatcattttttgggtgtgtctatttgattcttttctcttttcttctttattagtctggctagcagtctatctattttgttaatcatttcaaaaaactgtcccctggattcattgatttttttttgaagtattttttgtgtctctatctccttcacttctgctctgatcttagttatttcttgtcttctgctagcttttgaatttgtttgctcttgcttctctagttcttttaattgtgatgttagggtgtcagtttagatttttcctgctgtctcctgtgggcatttagtgctataaattcccctctaaacactgctttagctgtgtactagagattctggtacattgtgtctttgttctaatttgtttcaaagaacttatttatttctgccttaattcattatttacccagtagtcatccaggagcaggttgttgagtttccatgtagttgtgcagttttgcgtgagtttcttaatcctgagttctaatttgattgcactgtggtctgagagactgttataatttccattttttgcatttgctgaggagtgttttacttccaattatgtggtcaattttagagtaagtgcgatgtggtgctgagaagaatgtatattctgttgatttggggtggagagttctatagatgtctattaggtccacttggtccagagctgagttcaagtcctgaatatccttgttaattttctgtctaattgatttgtctaacattgacagtggggtgttaaatctccctctattattgtgtgggagtctaagtctcttcgtaggtctctaagaacttgttttatgaacctgggagcttctgtattaggtgcatatatatttaggatagttagctcttcttattgcattgatccctttatcattatttaatgccctgctttgtcttttttgatttttgttgctttaaagtctgttttatcagagactaggattgcatccctggctttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcagctccatcaggtcatttatgttcttctctaaactgattattctagttagcaattcctctaaccttttctcaaggttcttagcttctttacattgggttagaacatgctcctttagctcagaggagtttgttattacccaccttctgaagcctgcttctgcctatttgtcaaacttattctgcatccagttttgttcccttgcttgtgaggagctgtgatcctttggaggagaattctcactctagtttttggaattttcagcctttttgtgctggtttttcctcatcatggatttatctacctttggtctttgatgttggtgaccttaggatggggtttctgtgtggacatcctttttgttggtgttgatgctactcctttctgtttgttagttttccttctagcagtcaggcccctctgctgcaggtctgctggggtttgctggaggtccactcagaccctgtttgcctgagtatcaccagcggaggctgcagaacagcaaatattgctgcctcttccttcctctggaagcttcatcccagaggggcacccaccagatgccagtggagctctgttatatggggtgtctgttgacacctcctgggaggtgtatcccagtcaggaggtacaggagtcagggatccacttcaggaggcagtctgtcccttagcaaagcttgagctctgtgttaggagatccactgctctcttcagagccagcaggcagggatgtttaagtctgctgaagctgcacccatagctgccccttctcccaggtgctctgtcccagggagatagggacttttatctataagcccctgactgggactgcttcctttctttcagagatgccctgcccagagaagaggaatcttgagaggcagtctggctacagcagctttgcggagttgtggtgggctccgcccagtttacacttcccagcagctttgtttacactgtgagggtaaaactgcctactcaagccttagtaatggtggaagcccctcccccccaccaagctggagcatcagactgctgtcctggcagcaagaatttcaagccggtggatcttagctttctgggctctttgcgggtgggatccactaagctagaccacttggctccatggcttcagccccctttccaggggagtgaatggttctgtgtcactggcattccaggtgccactggggtatgaaaaaaaaaaaacttctgcagctagctcggtgtctgcccagacagctgcccagttttgtgcttgaaatccagggctctggtggtgtatgcacccaagggaatctcctgttctgcgggttgtgaagactgtgggaaaagtgtagtgtctgggatgcaatgcactgttcctcacatcacagtccttcacagcttctcttggctagaggagggggttcctcgaccccttgcacttccctagtgaggcaacaccccaccctgcttcggctcaccctccatgggctgtacccactgtctaaccagtcccaattagatgagtcgggtacctcagttggaaatgcagaaatcacccaccttctatgttgatctcgctgggagctgcagaccggagctgttcctattaggccatcttgctagccctataacctgcttttagcattgaatgccatatgagtcattatggtataacatttttacaacttaaaatttgttaaaattttaatcagttatagtaatgaacaataagcactttcattgttcttattgaaacaaaaccaaaagaagtgaagaaatgattgtgttcaatgatatatccaacctaacaaaaatgcccagcacatatttcattagtcctaacatatttttttttcatttaacatcattgaatttggattgcttcttataattgccagcatttttagtttaatttgtggaattatttccttcctagaaggatatataataatagttcaagatatacatcgcaatctaggactaggtgaaacacaatattcttaataaataaaataatgaagcataaactttttttaagtatgatgaatatcttgtgacaaacaaactgagattttacctaaaataataaggtttacattagtgacaacggagctttaacatcaaaacaaactttttcatatttatttttctagtaggacatctgcctgttatggtccttggagaataaataagatcacattaaaatgtcaacaattctcaatcatggtttaatttacagaggtattagtaattatctatgagtatttttcatttaagataaaatgatctaataatatagttttatttgtaaactttcagtatattaaaactatgcaaagtatttgttgctgttaaggactagcatagtatcattttataataaatagtaattcaggacacttttttaaaatcaaaataattatttgaatatttttggaaagatgccttttctcttatttttttaaagcattttgaacagtacatctgacagtccactagctcctcttagacgtggctatctaaacacaagccctccaatgaaaatactgattattattattgttttgaggcagagtctcattctgtcacccaggctagaatgcagtggcactatctcagctcactgcaacctgtgcctccgggttcaagcgagtctcctgtctcaatctccggagtagctgggattacagtcattgcaccaccacacccggctaatttttgtatttttagtagagaaggggtttcaccatgtaggccaggctggtctcaaactcctgacttccggtgatctgcccacctcggcctccgaaagtgctggggttacagatgtgagctgccgcgtctggcccaatactgattgtttttatttcctgactaaattccaaaatgtcttttttttgctagtgcagacattctcccatactggggtaaatgatattctcccatggttgccttctcaattaactattgaaaatgtttagtgtgtactttcacatagagagttaaataccgatgcaggtgtctatcatgaggacatatttccaatcaatccatattttactaatgttacatattttcattaagtaacattatttactcatggtgttcaatattgtgaacactagggaattaaaaagaagacaaaatccttgtcctcaaaaatttcacagtgtatgttggtaggaatgtaaatcagtgcagccatggtagacaacagtgtggaagttcctcaaaaaatgaaaaatagcactaccatatgatccatcaatcccaccactgggtatatatccaaaggaaatgaattcagtatgtcaaagagatatctgcactgctcatgtttattacagcaccattcacaatagtttattcactattcacaacaaccaagatattgaatcaacctaagtgtccaccaacagataaatggattttttaaaatgtgatgtggtatatgtacccaatagaatactattcagccatagaaagaaggaaatcctgtcatttgtgacaagattgatgaatctagaggacactatgttaagtgaaataagccaagcacagaaggacacataccacatgatctcactcatatgtagaattaaaaaagttgatctcttagaaatagagcatagaatagtggttactagagactggggagagtgggggtgggagtggggtagggggtgagggttggtcaatgggtacaatgttacagttacacaggaggaataagttgagaatggtgcatatgtcaattaccctgacttgatcactacactatatatatatataaacatcacactatgccccataaatttgtacaattattatgtagcaattagataaaaaagctttaaatttcacaatgcactgagagagaaaaatgaacagaaaattacagctaagagaatgccgttaacagaagaatgcaaaagagagcttcagagggtgttgagaaattgtgcttaaaagaatgatataattcagcctaaatggaaactaatattgagaatttactctgcaccaagacctatgccatccatgaattaccacaagttagtggccttaaaaaacacacagtttattattttgcatttctcaaagtcagaaatccaaaatcagattcactggctaaaatcagggtgttggcagaactgatatcttccaaagttctcaggcaagaatctgtttcctcctcttttccagcctctaaagatggccttcattccttggctcatggcccttctctgtctttgaagtcatcagtatagtatcttcaaatttccctctgactctcttacctctattttcctcctcccacctccttctctgtgtttcttgcctccctttcatatgtacccttgtgagtacgctgaacctacttggataattaatgataatcttcatatttcaggattattaatacatctgtaaagtcttttttgctaaacatggtaacatattcacagatttagtggattacaatgtagtcatcttaggggaagccattatccaaccaaccacagctccataatgaattaagggataaagaaggaaaaatgggttttaggagattctctggactgaattgtgtccccccagaattcatattttgaagctctaacttatagtatgactatgtttggagataggattttgaggaagtaattaaagttaactgagatcctaagggtatggtcctaatctggtgataggattgttagcctcatagaagagaaagagagagatccctctctctccacactcatgcacctaggaaagaccatgtgaggacacagtgagaaggcagctgcctaccagccgggaagagagctcttatcaggagccgaactggccagcacctccatctagcacttcccaatcatcggaaccttgagaaaataaatgtctgttgtttaaaccacctagtctgttgtattttgttatggcagcctgagcagactaatacagcagatgacaatgagatggtccttacaagacttccaggattcaaggaagaagtctgagctacaaatgtagatttgggatatcacagcctaaagacgatagttggtggtgatgaaagacattaacctgagatagtatgtagattgaaaatagaatatagctgagaacagaaccatacattactaataacactactatccaattctccaaatgtgctcagtagcctgattgtgggaggaatgactagcagatggttgaatttgttttaggtttcaattgcagggtgtgtgtggccaaagggcaagtgaaagtgggtggtagcaataacataagctgccagagacagtgctgggtgttttatgtgcctttacttcctatcattctgttaatcagatagtcatattttatagataaaggaaactgagattcgaagacattgagtaagtttcccagggtcacaaaaattttttttattacatttgatttctaacaggattcttctgatggaagaaatggaaaatcaatttcaatagtgcattaagcagagctagttttgaattgcaaatgttttttactctaaagtgaagctctttcaatgtacctcaagggaagaaatcaggtagtatgagaggccatctggtagagactgatacactaggtcacaaaaacattctaggggtagatgtatcagtgagtttgaaaagttgaaactatgaataacagtattcagtaagtgagtaatgtactggacttcatgatttcaggtgaagagaaaaatttaatctccttgaggacagtgctatatttagaggcatgctttagtggaaaagaataaaaacttgttcaaaaggaaaaataagctatctaatgtttgaaatatgtgtgatttgaaaaaaaatgatgtttttttcttaactcactcactgaagaaatccttaaccactgtatgataagaaagttaaaaaaaaaaaaacacctcattctcaggtcttaaagaaatcctgcttcctggcctagaccttacggacctagcaatgaaggatattcagagtggcatatttaacatgttctctatggtatcggtataattttaaaagacttagtggttacaaggaacttttctaagactcacatagctttacaaatatttacacattaatctgtatctctcaagaagtagataggtggtaggtatttaaccaactaacaatgatactaaagcaagaaaaagtaaagcgacttcctctaatgccacaaaacagttaggggtgacaccagaaatggaagccctaacttctaagatcgtgtcctgacaaatgcgttggtctactcctcctactaacaagccttgttaagcatgagaaatcttgcataatattgaacctctctgtgaagttgaatcagaagcattaaaatatcaattcagctgatgtttgaaacttgtaagttttctttaaaatgttcactttcatatgtagaaggtatgctatatatcaggaagaaatcagacagaattcatcatgagaatactggcatttcatccttgaatgacaagcactgaatacagtcagatgggtgactatccagataacattaataataacggaatttactttaagacttcaagagacgaatacacatccgtctagaactgaattaaaaatctaatgttgtatgtttttttctctatgtctcttcttttataactcctttatatgacattttaaaatattttttctgttgcctttacacaataggaaaatggattttatgcagttaaattaaataaaaaagatgaaactgaagacaggaatgcaaaagatactatgcaaattttaaaaatgttaacatattggaaaatttcttgacttctacatctaccctagaatatcccagctttgggtctaggttgttttcccccctcattcatttatttcattcatgcaacaaatattaaaaagatatttattatgtactaggtgctgtggaaacaacagaaaataaagacattcaaggcagaacaaaccatgtcttcatggttagatggtcttcttggttaatcatgtcttcatgacttagattataggagacatgatgggatcggcggaagtgttgaaatgtgaagacagttaataaataaatagacaagttcaaaatgatattcaaaagtaatttcaaataaccaaaaagtgttgtgtagtaagtatattaatactctcaagccagagtccactaggaacacactacagttgaacaaattgggtttatcacttattgaagcaggagaaaatacacaccaggaagaactatagtgtgtgtcagtaagagggtgttagaaagaaccaattatagaatttgggcttttgatgggtaatttgggagagggaccaaagaagcaggggtttgctctagattgaatgctatcagaaagtaaaggcaattctatgattagacgtctgggtttttttttctttttcataaatgttatttttaattaacaataattttatatattaatgggatgcagtgtgatgtaatagatgtgcatattgtagaataactaaatcaagctaattaaaaaatttgttacttcacatgcttatttttgtggtgaaaacatttaaaatctactctctcagcaattaaaaaatatacaatgatattatttattacagttaccattctgggcaataagatcattaaagcttatttctactgtctaactgaaattttatatactttgatcaacaccttccctttccccaccggtgcccccaccccacactgaatctggtaaccaccattctcctcccttcttctattagttcaatatttttaaattccacatcggagatcatgtgctatttgtcttactgtttctggcttatttcactttccataatgtcctccattccatccctgttgcacaagtaacagaatttcctttttcttaaggagaatagtactccaatgtgtgtatatacaccaggttttattgatccattcatccaataatagacacctatgttgcttccatatcttggctattgtgaataatgctacagtgaacattggagtgcagatagctcatcagcatattgatttctctttctttgggtatatacccagaagtgggattgatggatcatatagtaattctatttatcttgaggaacctccatatcattttccataattgctgtattcgtgtacattcctgccaacagtgcacaaggttttccctttctgcacgctctcatgaacatttgttatcttttgtgtttttgacaatggccattatatcaggtaacatctccgtgtggttttaaattgcattttcctgataattagttatagtgagcattttttattcatatatctactgccatttgtatgtcttcttttgagaagtgcctattgtaaatagtgctgcaataaacatggcggttcaggtatctttagacatactgatttttttttttcctttggataaatatccagcagtgtgattgctggatcatgtggtcgttcttttgtttgtttgcctttttttttctttttgagagatcctccatactgttttccatagtggctatactaatttatattcccatcaacagtgtataagtgtaaccgtttttctgcatcctcaccaacacctattatttttgtatttataataaaaaccattctaacagaagtaagatgatatctctttgggggttctaatttgcattttcctgataattagtgacattgagcaatttttctgatagctgttggccatttttatgtcttctttgcaaaatgtatatgcatatcctttgcccactttttaataaaattatttgtttttttgtttgttttgttttgttttttgggttgtttgagttccttgtatattctggctataggtcccatgtcaagtaaataattttcagatattttctcccattcaacaggttttctcttcactctgttgattgtttcctttgctgtgcagagctttttattttaaatagtaccatttgtctacttttctttttgatgcctgtgcgtttaagtactaagccatacaaactttgcatagcccgggatcctgaagtgtgttccctatgttttcttctattagctttatggctttgggtcctgcatttaaatctttaatatctctagagttgacttttgtatatggtgagagataggggtccaatttctttcttctgcatatggatgtccgatttttacagccttgtttattgaagaggatatcttttccccaatgtatgctcttggcacatctgtcaaaactccgtcagctgtagatatgtgtatatatttctgcattctctattctgttccattggtctgtttttatagcaatactataatgtttggcttaaaatagtgttatatcttttgaagtcaggtagcatgatgccttcagctttattcttttgctcaggattgctttggctatttgagctcttctttaattccacactaattgtaaagctgttttttctatttctgtggcaaattacattttgatagtaattgcaataaatctgtagattgctttgggtagtacggtcattttaacaatattagtcattacaatccatgagcatgggatgtcttttcatttgtttttgtcttcctaaatttcattcgtcagtgttttatgattttcctcatagagatcttttatctccttggttaaatttatacctagatattttattttatacattttagcttttgaaattacatttccttgttgattttttttcaggtagtttattattggtgtgtagaaacactgctgatttttatatgttgattttgtatcctgtaattttattaatttatttatgtgatctaagagtttttgatgaaatcttggttggggtatttttggatataagattatatcatatgcaaaaagagacaatctgatttccttttttctagtttggatgcaattttttttttttttttttgagacagagtcttgctctgttgcccaggctggagtgcagtggtatgatctcggctcactgcaagctctgcctcccgggttcatgccattctcctgcctcagcctcctgagtagctgggactacaggcacccgccaccacgcccagctaatgttgtgtgttcttagtagagatggggtttcactgtgttagccaggatggtctcgatctcctgacctcgtgattcacctacctcagcctcccaaagtgctgggattacaggtgtgaaccaccgcacccagctgtagtggtagtaattgagacctttctcttctaccagtgggttttatacgttcatgtgtttttctgatggtagatatcatccttttgtttccaggtgtagaccttccttaactattgcttctagggcccgtgtaatagtaattaattccctctgcttttctttctctgagaaaacaatgtatttcaccttcatttatgaaggataactttgctaggtgtggcatctttggctgctagttttatgtttcagaactttgaatatatcatcctattatcttctggcctgtaaggcttctgctggaaatctgctgttagtatgatgggatttcccttataagtgactggacacttttcttttgctgttttcagaatttcttctttgctttgacttttgagagtttgactgtaatgtgccgtggagaagacccttttcattacatctgtttggggatctctaagcctcccatgtctggatgtctaaatctcttgctaaacttgggattaagttattatttcattacatagttttctctcctttcggtattgtcttcaccttctggaacattgaaaatttgaatatttggtcactatatggtgtcccatatgtcacatagcctttattattttttattgttttatctttatttttgtagactggtttttgtgaaaagacctatattcaagttctaaaattcttcttcttgatctagtctattcttgaaccttttgaatgtatctttttatttcattcaattacttttttaattccaggatttctgcttggttctttttttataatatctatctctttggtaaatttctttttcatatcctgaattgtttttctgatttctttgtattacttatctgtgttctattgtatctcattgagcttctttaacatcattatttttctctgattttataaatttctttttttttttggaatttgttgctagagaattattgtgttcctttggaggtgtcatatttctttgctttttcatgtttcttgtgtctttacatttatatgtgtgcatcttgtataaaagccacttgtattagttcattatcatgctgctaataaagacatacctgagactgggtaattcataaaggaaagtggtttaattgactcatagttcagcatgactggggaggcctcaggaaacttacaattatggtggaagaggaagtaaatatgtccttcttctcaaggcagcaggacagagaataatgagaaccaagccaaaagggaagcctcttgtaaaaccatcagatctcatgagaacatgagaacttactgtctatcatgagaacagcatggggaaaaccaccccccattattcaattacctcccactgggtccctcccatgacacatggggattatgggaactacaattcaagatgagatttggatggggacatagcaaaccagatggcaagctctggccctgtggtggcggaattaggttgggtaagcttgtactcacgttcccccatggggcatgacagtgcacccaaattcagagggttgggtgatgtgagtttaggtctcatgcccctgaatacaaggagttgaaagctgaaatggtcaatatgatctgcaaaagtgtaggatagtgactaccaaactgtcttctggagagcctttttcaaaaaaaaaaaaaaaaaaaagacaaggttttgctctgttccctggtctggagtgcagtgacatgatcatagctcactgcagcctcaaactcctgggctcaagtgatcctcccacctcagccttctgagtagctgggactacctttgccactacacccagttattttttgtttttaaaatggtcttactatgttgctcagtctggtctccacatcctttcctcaagtgatcctcccacctcagcctctcaattagctaggattacaggcatgagacaccatgcccagctgggaagtgttaattgttgctccaagatcaaaagtttctgtagtggaaaggatgctgaattttgtcaaatgctttttctgtatctattgagatgatgatgatttctgtttctttattcagttaatacagtgtgtcacatttattggttttggtaagttgaaccatctttgcatcccagggataaattccagttgatcatggtgactgactatttttatgtgctgttgaatctgatttgctagtattttgttgagtattttttcatctaccttcatcaaggatataggcttgtagttctgtttttttatattgttcttgtctggcttcagtatcagggtaatgctggccttgtaaaatgagtttagaagtattctctcttcttcaaggggagattttaaaaaagattggtatttatttcttatttacatgttagataaaattctgctgtgaagtaataaagtctgggcttttctttgatgggagattttttagtgttgattcagttttattcttggtctgttcaaattttcttttatttttcttaactttgtcctcgtagattccatgtttctaggaatttatcaatttcttctaaattatccaatttataagcgtaaagttgttcataatattcacttatgatcctttgtgtttctgtggtatctgttggaatatctcctctttcatttgtgatttgagtcttatctctttttttcttagttggtctggtctggcaaagggtttgtcaattttccttatcttttcaaaagaaaacttatttagttgatcttttctattctttctaatctctactttatttacttctattctgatctgtattatttccttccttctgctaacttcatgctttgtttgttcttccttttttagtttcttgagataacattaagttgcttacttaagaacttttctcttttgtaatgcaggcatttattgctataaacttccctcttagaactgcctttggtgcatcccataagtttagtatgttgtattttcattttcatttgtccgaggatatttttaactttcatttttaattccttccttgatccattagttgtacaggagtgtgatgtttaatttccacatatttgtgaattttccagaatttctcctttattactttctagtttaattccattatggtcagaaaatatacttgatattatttcagctttcttaaatttattaagaattgttttgtggcctattatctatcctgtagaatgttactgtgtgcacttgagaaaaatgtgtataatggtgctgttggatgaaatgttctgtatatacctgttaggtccatttggggtaaagggttgttgaagcccattctttttctactgatttcttgtctgaatgaactatccatcgttgaaagtgcagtatttactattactgtattatactattactattactatattatagtctattactgtattatagtctatctcttcagatttattaatgtttgctttatgtatctaggtgctccaatgttagatgcatgtatattttaaatgcttatctttttaatgaactgacccttttgttattatataatgacctgctttttctctttttcccaatcttgactaaaaggaggtcattctaatataacaattatataagcataatcacctcactctgtattgatctaatctaatacaagcataatcactcccatgctctattggttaccatctgcctcttattccatacctttgctgttagtctatgtgtgtccctaaagctaaaataagatttttggagggaaaatattattggatcttgttttttaatctatttagacattattttaactgtagactgtaatctctttacatttaaaattagtatggatagatatggacttactataggcattttattaattttttactgacttttgtagttattttgtctttcttccaatcttacagtctttctttgtgatttgtgtatttttgtagtaatatgctttgattcctttctcttcatattttgtatatctgccagaggtttttcattatagttatcatgaggcttgcataaaatatcttatagttaaagtattctaatttaagctgaaaataccttaactacaattgcatacaaagactctatgcttatatttctcctccctcacacattttatgctattgatgcaataatttatatctacttatattgtgtatgctaacccattgtttatagctataattgtttaaatacatttgtttttttaactattatactaatgagtgatttacataacccctttacggttttagtatattctcaatttgagtatatgtttacctttagtagtaagctttatacttccatatgtttttatattttacttattttccttttatttcaactcaaacaattcccttaagcatttcttataaggccagtcccatgatgatggatttcctcagcttttgtttgtcttagaatgtcttgatctcatttttcatttctgaaggactgtgttgctgggtgtagtatgttttgttaacttattttttagcactttcaatatgtcatgccactccctcctggcttgcaaggtttctgttgagaagtcatgtatagtcctatgggagatcatttttatgtaataagtttcttctcttttgctgccataaagcttctttgtttttggctttaatttgattacaatgttaaaatcagaaaccaatgagatttaaggcagcaagaattttgagtttatctctattgagtttatctttcttggggtcctttgaggttcctgaatctgtatgttcatatccctcccaagatttgggattttttcaaacagtatttctttaaataatgtatctctgtctcgcttctcctttggatactctcataaattttatatttgtacatttgatggtgtcccatatatccctacactttcttcactcttttttgatctttttttaattcctctaattagctaatttcaaataatctttcttcaaattcacaatttctaatttttttgcatgattgcctcagctattcaaactattgagtttttcaattctgccattgtatccttcagcactaggatttctgtttggttcttttccacggtttctatattttatcaaacttctcatttcattcatgcattgttctccttatttcttttagttgtctatctctatttgttgaatttctttgagcttcttgaagatgagcattttgaatcctttttccagtaatttgtacatctcttttttggtggggttggttagtaaagccttagttattttgatggtgtcatgtttgcttcattctttgttattcatgtaggcttgcatttctgtctgcatttgaaggagctaactcctctttcactctttatagaatagatttgacaaactaaaattttctcctaataggtctgcaggttgatgagattacctctgggctcatgattgagtggcattggatgcaggtcttgtgcctgatactgggtctacagtggaaactgcagttggcagtgttgttaccagaagctgtagttggtgtgggtcccatttggtttctgggcagactgaactgtctccagatctttgggtctggatctgggatgatgaaggtctgcttcaggattcacagattgcaggtctttttccacgtgcaatgatggatatggcttccgctgggtcactggcaggactcctgttggataactaaatgagtacctgtcctagccatactgtacaaattggtggctgagatgggcttaaactgagacataagattgtttcaggatatacaaccaaggctgagatctttagcccccacgaataggtatgtgtacagtggtttcctggatgagcaagcctgctttcagactgcagtttaaaaaggtgggggccaatttatagggccatttaaagatccacaatgggacagaggtgagggattcagcctgaatgggcactgtgggacatgccttcttgtgcccaagcaggccaagcttctctcagtctgaagacaaaaggggtctggacctaaatccagtgccatttgaggatccactgtggaacagaggttggcaaagcgtgtcagggaaacagacaggcatgtctcctggtgggattccagctgggcagaattgcttcaagaccacagctgggagggactgaaaccaatcttcagggctatttttaaatctgctgtggaactgatgttggcaagcctgacccagtggcagtggggggtgagaaccccaatagatccctatgtggtcaggattgctcatagactgcatctgagaggggctagagctgagatttggggcccagttatggtcttctatgggatgaaggccagcaagactgtccaagtgcatctctagcagttccttgcatggtggaataacttcagggctgtgacagaagggctggtgcctagaaaggtcccttcaggatctgttatgggatggaagttgtcaagcccattagcactgatgggctagtcaccctgtgccattgggattattcccaggctgcatttaagcagggctaccatcaagattcagggccccttcaggacctgctgtgggatggaggctgacagtctaatggcacagatggatgagtctaccagcatgtcttattatggatgggattactcccagactatggcagagaggggctagagctgagatagggccccttcatgatctgctgtgggacagaggctgcaagtctgtcctggtagtatagatgggtgagtctctctctaggtccctgtgtgagaagtactaggctagaattacagctaaagggggctggagccaaaagctgttacaggatagcttttgggttcacggacaaaactgatggcaagaagcagatgggtctgtctgtgaagcactaatgtgcatgattcctcccagccctttggtggatgcttttggaagcaggctcaagcacaaacggagctgtaactaaaccctttggaaaatggggttatttatgggtctgaagctgggtccacaattactgggtctgccacctaggtgcaggtctgtactctcaaaacaataatcctagatcttgggctccactctggtttcacaacctcataccccaatccaagggctcccacaaagaaattttttatcatgaatgggtgcagaattattttttttttgtggagtaatacaagtgcgtgaccacctattctgccatcttatctcatcccctagatatctgttttaattgcttcctctttaccctgttggtgagggaaggattttgtacctcaagagatacctatggagacagccaaacacacagaccctatattggacagatgagattgatgcatatttattaatcacatacacttacagcccagaggagggagataccacacaccatgcagggccacataggggttgcatttgggaaaaaaagtgaacaaccatgtgtatgggatgcagtttggtaacatcaagagggcagggtactcgtcgatactcaggaggatgtgattggcttgtttgagtagctccacaggctggcatggaactgaaacttacttctcagtgatgaagaagaacttgacctgatctatttgataaggcaggttctttggctaggaaatcttatttacaggagcagagtaaggaagaatgtttcctgtaaggctatttatgcccctttcagatgccctcagctatcacagaagccaataatattgggccttaatcttaggactcgcaccatagtatattaatgaatcttagctatagaaagggaaggaaagatatgagaataaagctataattggtttcttaaaaattgcactcattttagacaagagacaggatttctggtgttttggggtggcacaatgaccttgcctttgtctgtacttagacaaaattattaagtgaccctactttgtctcattttatcatggtctcaaagtagcctgaggttcgtattatttccaataggggaataaaatagcatagctctgagagctgggccaacttccaaatctcagaggctgctatttattttctttttacagttaaaagggcctgttggtgctgggaggctaaattagatgggttggtcaaggaaagttttctgagagagggatgtcaaagctcagcctttatcactaataaggagccatacacatagagaagaactgaggagagtagagacaggagaggaagggagacaacctgtgggagagcattcctgtctgagggaaatggcaagtatgagcaaagaaacatttcatcacacccaagaggtgtgagaaaaaccattgggaccgtggctctttgcttcaatgctctctagggttggatatggaggaagtaccagaatctcagaacatgggaagtaaactttggaaagcctcaaagtgatcctgatacagtggtcctccaagacagattgtctcttactgcctgtatgcttccctcacagatttagttcaattatatagactttatatgaaaatcccaatactaattgatactttaatatgaccctgtataacatacaacaaaattgcttgtccaggaatgttttaccaacatccagggagatagatggggttattagctagtgaatgtgctgtcagtggcagaagatcaattatcctatatataattttgttttttctcagaaactagactgtggtgatttttctagaccatctaacatatatttgagcaaggtctgcatttccatttaatagtgaagcattcctaggatgtgagttttatcattccaatcatctgttcatatccagttcatgcatttgaacactattacaatagttggtttgaagacaccattgctaccaactgggaatttaatatgccaacacaggaaaatattaacgatgataaacagctcagacagcagagaataatggttacaagcatggactctgaaaccagacagcctaggttcaaatgacaacactaccactttctagttgtatccctgttaggtactttacttagcttacatgcctcaattttctcaccaacaaattgggataatactagtacctacctcaaaggtttactgggaagaataaaatatatagtaatttcttagacctgacacaggataacactatgtaagacctacctttgtaatgatgattacaactatgtattggaaaagaaaaaaaaggtaattaatacagtattcctatagttgatgagttaattatgtactaaccagtatatataaatgttcacagatcttattgaggaataattcctatcacttatggttctatacagggcctctcctctttctacaatgtcaatcacataataaatcagtttttagcaaaatctgaaactatgcatttaatttaaaatttttttttcctttctgcctcgtatgtctgattcattcaagcctactgtagataacagttttaatacattctgttactgagctttttggactttgcctagagaacacactaagagtctcagatctttaattgaggcaaccgtatttagtaccactgaaataagtgtgaaaacagcttgatcatgcaaagcttgacatgaagaaaacacctgcctggtgttaataagatacatgaatttcagacaacagaaaacaaagaaaattaccactttgtctatcttggtaaaataccaacagaattctcattattttcatgacattcagaagtttatttgaatttctatgaaatgtgaacagaaaaaaatcatatggattatgggctcctggtgggtgagggtttttaaaatattactggatttttatccatactatcagatttattaagacaaagtaaaagaaaaaataaggaaaaaataaatatttgttttgttctggatattcattagaacaaaccagagtgatctgagaatcaatttcaagtatcttaataggcctggatgtattggacattagtgtaaacacacatacccacttctcttaagtttcagggtctcaatagaaatatgttgaaagttcctatcaattggcacttttatgcataagagaaaatcttttactttcacaaacctactttagttgtttaagaaaaggaaaaatcttagtaataataatacaacagtcattaaaggaataacttagcgcagataccatcttctgataatcacccctcagagccttgattctaggctgtgacattatcagtttgcattggtcaccaaacagctttgacatggtattacctaaatcattgcattattacaagcacaactgaaaaactacaacttcttttttttttcagtgaagtcaggaaattcatcctccaacaggttgagagaatcactaagaaaaaaaaaacaggattattcttgtgtttgttgccaaatttatacaagatttataaaacgccaatatcatatgcactgaattttcagtgttttttgtttgcttgcttctttgcctgtttgtttaacatatatagaataaattatcttgttagactgctttctatttctaatggacatgtgtacacataattttttggaagcaaagttacgccttgtttccttcctggttatttattttgcctaaaaaatcttagtacctacaccaaaaggtagttaatattcatgcatagtcagcatttagttgactgtgataaattgtcaaaagaaaggataattgaaatctattgtactgccaaatctaattcgatattctatgcttaaacttatattgtgtcttacagttggccataagtgctaatagaccaactgaagatattttaattttaatttctttcatccttccaaagattttgataacttaaaacttgtatgaatagtactttacagtttgtaagcattttgacataaattgtcacttttgatcttcccaatatccttatgggaatgagagattataggattatggaagattttattattctcactttatatattaataaattgggaaacagtcatcatgttcttaaggaaatgcaggtaatcagctctagaaaaattaaaagtctagaatttcaaagtttgttgaatgcattacattgcactgagaaaacccattaccttttatccacaataaccccttctgtctccttgctgccctgtgtccatgtcattctctctactgtttctggaactttgaatgtttttcttcacttcccttactccttttatgcacactgtcttgaatgtccctgcttctctcaaatacctaaatcctgctcatctctcaaggtctagcataagtttcatcccctccaggaagtcttccagcccccactgttcttacttaacaaatatagcacttacaggaatttattaagttcttaaatgtttaatttatgtgcatctaaattctcctaccagattataagcacctgagaacagagaccaagtcttatacttctttgaaactcacaacattctagcactggatatagatataataaatgcttgctaaatatttggttattgtttaattacccaatggagacaatgctgaaacatatctcatcttccttatctgcatttccatccatgtggcttgtaatgtagcctgtataatcacttactatggtagagttcagtgtgggttttttcaatacgttcatacatcaattgaccctaacattaatttctaactgtcaatgacgcccagtcatatgacctaggggatcgaattaactacacattcctgatggattccctgaatagagtaaacatttgggccatatttcagcattgagaacaggaacagaagacattatgctgtgattgcatttctatagaattacattagcattacccattctgctagtcataatttctcagcagatcagggatatctatcaatagtatttcctgtgatatagcacatgaaaatgcattccattattcattagaagtgttgctgatcaagtatattatccttataaacttactctttaagaaagaaatgtttatatgaaaataacatacttaagagtcattatgtgaaaaaagtatgtcactgtatgacagtttgactcttctgaaatgtaagtgttcggtttaatcaaataactgcttttgttcatattttaaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagtaagttactgagtttcttcattacttctttcacacacctatctcagtttttttttaagaaaaggaaaaatctttcataataataccacagtcattaaaggaataacttagttcagatatcatcaccccctcagagacttgatcctaggctgtgacattatcagagtttgcattggtcaccaaacagctttgacatggtattacctgcaaatcattcctaacataacttaaagtaatgaatcaagagtaaagggttatgtgtttttgctttgttttgttttgtgttttgaaatgtcaatagtaacagaacaaacactttcagtgttttgggtcattaaggtaaaatatttctgtttagaaataaatgtcatatacaaatataaaatgctttacctggagtaaaacttataaacaaaaattcggcatggaacctatataaatggcattaggagtaaattattataatttatataaaatgaaaaaagtttacaattcctcaagtaaaaattcttctttcacagaaataatggaacaaagtttattcctttgaaaagaaatgttttcaaaaatccaaaattagcaatatcctctaagaaatagattgctatatattcactttcatttgaaaaatgatagggcataaaatatgacaatatttctcattactttattcactaagaattattatatataaaatccaatacagatttggccttttaaaaataacttcaatccttgaaagaggcatttttctttcataaaaataacatttattttaaaatcttttaaataaaattgtaactttatgtcatatttggaagcaggaaagtataaaagcttactaaagaggtgcaattgactctgtgtctgaaacacctaagtccttctcacaaggcattgtccaacatgctacccaaaatgaatagattcctgacagctatgaaagtttggaagacagaaaagaatgcttctgatgacagatgttgcagtggactattactttagtggccttaatggggcatttcagtgttcatgtcgttgtgtagttttttcccatattgattctgggcttttctatgtaacaaaccttggccaatgggacattagcaagtgtgatgcaagtaaaggcatcttacatgtttgtacgttggagcttgtcctcttgccacactctttcctggaacgagtctctatgcctaataaaggcaatccataagatgaggccacatgcagtactccaaagaagagaactgaggtgattcagccaatatccacatctgaactccaagcggaatgtcagcactgaatgcagccttgtgagtgaaccatctctgatgttacaactccactacaactgctattagatagctatagctgtggttgacatcttgtgcaggaaaggaaccatgcacctccatcccatcaacccataaatcacaaaagatgattaaatggttgttgttttaagccactaagtttcagatggtttgttgcacagcaatagataaccaaacagatggaccccagttagaattctgctcctgccacttaagaattatgcagctatgggtaaattacttaacatctgtatcctttacttccacatctgtaaaatgggacaggaatgctgtaagaattaaatttgtcaatgtgtaatacatttagcaccctttgtgcatcattgtaaaccacattcaataatattctttattgggactatatgtgctagcactttatacgtatacgttaccatttcattctcacagcaaccctaattgatatcattatctacattttatgtatgagaaacgaaggcccaggcaggttaactaacccacataaggacctttaacctacagtatgtggcatgactagtgttcaaaatgaagtctgtctcactttaaaacccacccccccctttttttttttttgcttttgctatatccctttgaatgagttttatactttaattatcttatttgaattgaacaacattaaataaataacaatctgaattaaataacataattctgcctttcagaataggaaaaaaatattcaggtagagtgatgttaattgcccctaagatataaaatttggaaagagccagctatgccataacacctggtaaagattatgacctaaaagagagaaacagagagacagaagaaatagatgttaattatttctttcatattttctgacttccttgttattaatttaacatgaacatttcaagttattccttctgtattatatatctctggcaggcaaaagataattttcaagttgggttatgaacctttgcagagcattttaaatcacaatttaagcatgatgttgaagtcctctgatgtgtgtttatgcatgaaacatctggaaatgagcatccaacaataaattaaaaggtttaaaaagcgtcatatctttattttcttactttaataaatcaaattatgcctttctccttatatgtgaattacacatctatcctttctcaatcacagacacacacacacacacacgaaaaggaaaaaagatgtatatccctgtgaaatagtgggaatcatttatcctacatcaactaaatatgtttaataaggtattatgtggtacttgcctgccagtttgaaatagtttatttcacataagcatccaacatagtgattgctttacaactctaagaatctcatctagaaatgagaccagtgacctctacttagccacatttatatgatttacaagtcaaggtttttgttccacttcttaaaaaaaagaaataaaataaaaatctcatatctgttataggaaaacggattgagaaaggatagattcagtatactgttgagtgacaatcaccattgtagcattaacttgttagagtgagccccgtatagggtggtgtggagctaccaaggtgggttgtagagatggagaagggaataatcctcgtaaagataaatgggcaggtttatattgttatcatcttgactcaagtgctatgggactgttagaagaaagccaataaataaatgagtgcctcattcccataaattcatagtaattattccaagattacccttaagtagctaagagatagctagcaattaatgctcccaaaggactacccattgcataaaagataatactgatcaagataaagatgcagtataggcttataagggcatgtttgtagagtatcctgggattctgagaaataaattcatagactctcagttgaaagtaattcaaaatctagatcaaaatcttcatcagattcttttacaaattcttaatatgcatttttttttatctcatataggatttatctctgaaagacaagtgttataaagttcttgggaacactttggctctctttcatatttgggcattattttaaacttaaaagttaaatgattaaaagctgtattatccaaaaaactgtgtttgataagagttgaacctatttgtttgatatgcatcacaatttcattaacctattaagatacaagtgatataaaaagagattaattgacccataaccatatgcttagtacatactttttctccaagaagcaaatagaagccataagttagaggacagacttgtagccattaatagcacagataatagcaatttgtaacagataacatatacaccggtgtcattaactatataaccaacagagaaagagctacggttctacaaaaaagcaagaactatggtttaatgatgaagaaatactgtgcagtaaccacacttcagaatactgggctctgcagtttgaatttatgatgatggaagaaccaaaaagtagtaaaaatgaagtgcctacctcccagcttagacagcaacaactaaatttagatatgccaactgtatctaaaataaatcctaaatccagtaaagagcaatagaaaccaatcagggtagcaaacaaattcccaaacataatttcatttcataaaaatattccctaaatattccatgagacagtattgaagttataacagaaagtgctgcgcttgctcaaaaccccctttaatactcaagaatattgtgggttccttctggagaggcagagtgggtccacatgggatctgggtaagagagtagattcaagccagccaaatacattttagtacttgcacaaaaactgcttctctggttccagaattttgttctgcttgttaagtaataggcattccccaaaatttctgctactgtattactgtattagctatgacatctgctgctctacctggttatatttgggacagtcccataaccactttgggccttaattttcaccaccacacacaaaaaaacgaaaagtgtaagtaaattagactagaaaacattaaaggtcacatttacctttaatattttgtgattccattttgtttttaaaagaagagtcatgagatgttggtgaggtttaaaatttgtgccagtgataacttaccactccacctccaactttattataacttcaggtgcatattgatgacccaataagaaaatagaaaagttcaggaagaaataagcaaagaaaaaaacagtgcctttgataaagttttcaacttataatttgtaaagtagaaaagttataggtaaaatttttctgtaagtaaaatcaaggttgggatatgtataatatacattgtatggggtaaaatattctgtatgtctgattttactgatatacattagattttttttacccctgaggttcagctcctagttaaggtaggttaagagtctattggtttttgttcttcccccaaacccaagaaatatttagtgagtttgaccaggtattaggccctattgctgattaaaacctagtgatagagaaaagaaggctcagtgctcttgagaagcccatttgttggtgccagtccactgggagcaacaaataagtgtgtcattatttcccaatatggtgtggtgtgtgctgttttcgttataattattcaataatttttaaatttattcattcagcaaatatttatttagtgtccatttttctagtcaacttttgtttgtttgtttgagacggagtttcactctgtcacccaggctggagtgcagtggcacgatcttgactcactgcaacctccacctcccaggttcaagtgattatcctccctcaacctcccaagtagctgggatcacaggtgtacgccaccaagtccagctaatttttgtatttttagtagagacagggtttcaccatgttggccaggctggtctcgaactcccaacctcaagtgatccacctacctcggcctcccaaagtgctgggattataggcatgagccacagcacctggcctctagtcactgttaatacagtaatgaaaaaagacagaactaactgctagaggagacaaaaagaaatctaaatatttaaatgtaactttaggtaaagagcaaaaacctgaatgcagggagggagcaaaccatgcctaggtgtgatagaagagtattctagagagaggaaaccactagttacatacttttgttttaagaaagaatttggcatgttagaggagcacctaataagcaaagtaataatagtgtggattacatagtgaaaggagaaactaggggcagacaaaatataaggaggctagtgtagtattccaagtaaaaaataaggagaaaatagagtaaagaagtcaagagaaaaagaaagggatagattctagatctacttcctaggtgaaattaagacacttcagtgacttcttgattgtatagggggaatgaggacgatggaacagtttcaaatgacttccaagtgaatggtttccataagtaaaaagatggagagggaattctggagaaataacagatctagagggaaaatagtgaattcttatttggacatgctaagtttaaggtgtctgtgacatttagttaaagacttccagaatgtccctggagcctgagtgggctgcaggttcaaaagaaggagaactcgatagatggctgatggttggtagttgaagtcatagggaggatgagattacccagaagattgaggagaactagcattaagaggccaactgaagaagagaagtgtatgaaaaagacagaggagcaacctgaaaagcaaaggacaggtttctaagagtgagagagaggtcaatagaataaaatgagctgagaaaccaacttagatggattgagaagcgtccattggatagggcagagggcacagctcatgaagcatatcatgggaatggaggccagatggcaatggatttagagtgagatatgtgcacactgcaatcagattcaaagatgttaaaatgcaaattagattgtgttgattccttacttaaattccaaatgttcagcatttttcagttaatcattaatctagtaatatttatgaactgcctagctactacatactggacactttctctctctttctttctttctttctttctttctttctttctttctttctttctttctttcttgctttctttctttctttttctctttcttcccttccttccttccttccttccttccttccttccttcctttctttctttctttctttctttttctttctttctttctttcttctttcttttttttttttgagacacagcctccctctgttgcctaggctggagtgcagtcgcaagatctgggctcactgcaacctttgcctccctggttcaagcaattctcctgcggcagcctcctgagtagctgggactacaggcacataccaccatgcctggctaatttttgtatttttcgtagagatggggtttcgccgtgttggccagactggtctcaaactcctgacctcaagtgatctacctgtcttggccacgggaagtgctaggattacaggcatgagccatcacacctgccgttccaggcacttttctaagcattaggtgttcagtaatgaataagaaagccaatgtgcctgtcgtacctgggtcaggtccctgagtctacctcctctggtttcattgtccaccattcttcttgaatcctagattgccattcatgatgaatgacaatggtgtctccaaacttgctcctcatttctcccaggtttctcttctttttctaaatctgcaaggagctagaagacaatggcccaggctgatcctaaatgggtacaaaagtaaataactgtgatatgaaaaggattgtggtatctataacactcaacttcctttcaagactggagttagcagtcttcctttatttcaatgatgtgagaagcaggatcatttgctgaggtggacagcaagactgaggattgagatgcttgtgaatgcttgaagtagctcccatgaagaatgtgaaagaaagctgaccaggaaataatagaaagattgaggacatcactgaggattcaggaacctggagatcatgacagaagctgctgccccaaaaagcactgttattaattagggaaagagttataggatgaagatgagaagagattaaatccaagggaaaagggaaaactgggaggcagcagcaagagaagaaatggtaattttctgtactttctctgttcttctaccaaccttagtactttttgctgttgttcaaaaaataaatggtgatttactgtgctttctctcttctaccaaccttaatactttttgctgttgttcaagaaaataaattattcttgtgcaatttctagaggcttgatggattctcaggacatttactgggaactatttgccatgtggaattataatgtacacatattgataaacagaaaacgaactaagtgtgactgtaacagtgactagatgacatagcctgatgaccctgtgtatcacactctgttcaagcaggtctagggataattggaatcactggcttattttctctcttccagagcacacttcccttcttataagaaaagaataaactctttctgtatgcaggaataatttattggttgtccttctagtgtttaaatatctgggttttctcaaggtcattcattcaaatcacctccctagaattacctctaacctattccctagttctgtggttttctcctgcccctaaactatgctgctaattgtcgggtagactacactatgtagtaacagctgtaaaaacatctagtaacaagtttctcagtgtgaaggtatcattgtaaacagtaagagccaaaaaaagaagagaatataaatgcacttttatgcatacataatgttttcttttatactgctaaataaaattgaataaagccatctaaaggatgaaatcttattgactttcaaagaataaaaaatctctcccaaatcattcatgatatgatttgttctagataaagagtgtgataaatccaaattgggaagggctgtagataaacccatattacaggcatgaattcgcatccaggaattcaggagagtaagaaccaacctgccaggctgcaggataaggcaatcaatcatcactgagaaatcttcaccaagtttctaatggtcttatgtagggctggataaaaaccggtaaaaatcttcatcactgaaaatttaacagacccccttttaatgcaatttctagttaaaaaaaatccatgaaattaacaaatgaaaatctggtaaggtcctcatttaatccaatgatgacattttaatgctagttttcttgtggttgctgctgctgttgtcagaatatgttaccgtgccatttttcaaattttcattttggtataatttcagtcttatagaaaaagttgtaaaaatattacagttctcatataaccttcactaactttcccctgtaattttagtattttgcataatcataagattattttcaaaaccaaaaaataaatattagtatggtagtattaattaggttggtgcaaaagtcatcatgactttgccattaaaacttaaaagacttttgcatcaacctaatactaaactatagactttcattcaggttttgtcaggtttttcactaatgtccttttcgctgctccaggatccagtccaggatcccacactgcattttgttatcacgtctcattagtattttcaaatctgtgacaattcttcaacctttccttgtcttttatgaccttgaaacctttcatgtgcactaatcagttattttgtagactgtccctcagttcgggtgtgtcttgttttcttttttttgtttttttttttttgtttgtttgttttaaagaagtttgttgttgttgtttttaatttttaaaaataatttcaacttttatgttagattcagaaggtccctgtacaggtgtgctgtattagtcagggttctcttagaaggacagaactaataggatatatatatataaaggggagttaatattaagtattaactcacatgatagaaggtcccacaataggccatctgcaagctgaggagcaaggagagccaatctgagtggcaaactgaagaacttggagtccgatgttcgagggcaggaagcatccagcacaggacaaagatgtagactgggaggctaggcctgtcttgtcgcttcatgtttttttgtttttttttttttatactttacgttttagggtacatgtgcacaatgtgcacctttgttacatacgtatacatgtgccatgttggtgtgctgcacccattaactcatcatttagcattaggtatatctcctaatgctatccctcccctctccccgcaccccactacagtacccagtgtgtgtgatgtttcccttcctgtgtccatgtgttctcattgttcaattcccacctatgagcgagagcatgcggtgtttggttttttgtccttctgatattttgctgagaatgatggtttccagtttcatccatgtccctacaaaggacatgaactcatcattttttatggctgcatagtattccatggtgtatatgtgccacattttcttaatccagtctatcattgttggacatttaggttggttccaagtctttgctattgtgaatagtgctgctataaacatacgtgtgcatgtgtctttatagcagcatgatttataatcctttgggtatatacccagtaatgggattcgtgggtcaaatggtatttctagttctagatccctgaagaatcaccacactgacttccacaatggttgaactagtttacagtcccaccaacagtgaaaaagtattcctatttctccacatcctctccagcacctgttgtttcctgactttttaatgatcgccattctaactggtgtgagatggtatcccattgtggttttgatttgcatttctctgatggccagtgatgatgagcattttttcgtgtgttttttggctgcataaatgtcttcttgtgagaagtgtctgttcatatcctttgcccactttttgatggggttgtttgattttttcttgtaaatttgtttgagttcattgtagattctggatattagccttttgtcagatgaatagattgcaaaaattttctcccactttgtaggttgcctgttcagtctaatggtagtttcttttgctgtgcagaagctctttagtttaactagatcccatttgtcaattttgtcttttgttgccatgcttttggtgttttagacatgaagtccttgcccatgcctatgtcctgaatggtattgcctaggttttcttctagggtttttatggttttaggtctaccatttaagcctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagctgtagatatgcagcattatttctgagggctctgttctgttccattggtctatatctctgttttggtaccagtaccatgctgttttggttactgtagccttgtagtatagtttgaagtcaggtagcgtgctgcctccagctttgttcttttggcttaggattgacttggctatgtgggctcttttttggttccatatgaactttaaagtagttttttccaattctgtgaagaaagtcgttggtagcttgatggggatggcattgaatctataaattaccttgggcagtatggccattttcacgatattgattcttcctacccatgagcatggaatgttcttccatttgtttgtctcctcttttatttccttgagcagtggtttgtagttctccttgaagaggtccttcacatcccttgtgagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttgtggagattttgggctcagatgatggggttttctggatatacaatcatgtcatctgccaacagggacaatttgacttcctcttttcctaattgaataccctttatttccttctcctgcctgattgtcctagccagaacttccaacactatattgaataggagtggtgagagaaggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatgttgaaccagccttgcatcccacggatgaagcccacttgatcatggtggataagctttctgatgtgctgctggattcggtttgccagtattttactgaggatttttgcatcgatgttcatcaaggacattggtctaaaattctctttttttgttgtgtctctgccaggctttggtatcaggatgatgctggcccataaaatgagttagggaggattcactctttttctattgattagaatagtttcagaaggaatggtaccagctcctctttgtacctctggtagaattcggctgtgaatccatctggtcctggacttttgttggttggtaagctattgattattgcctcaatttcagagcctgttattggtctattcagagattcaacttcttcctggtttagtcttgggaggatgtatgtgtcgaggaatttatccatttcttctagattttctagtttatttgcatagaggtgtttatagtattctctgatggtagtttgtatttctgtgggaaatttgcgtctatttgattcttctctcttttcttctttattaggcttgctagtggtctatcaattttgttgatcctttcaaaaaaccagctcctggattcattaattttttgaagggtttttttgtgtctctatttctttcagttctgctctgatcttagttatttcttgccttctgctagcttttgaatttgtttgctcttgcttttctagttcttttaattgtgatgttagggtgtcaattttagatctttcctgctttctcttgtgggcatttagtgctataaatttccctcaacacactgctttgaatgtgtcccagagattctggtatgttgtgtctttgttctcgttggtttcaaagaacatctttatttctgccttcatttcattatttacccagtaggtcattcaggagcaggttgttcagtttccatgtagtttagggttttgagtgagtttcttaatcctgagctctagtttgattgtactgtggtctgagagacagtttgttgtaatttctattcttttacatttgctgaggagtgctttacttccaactgtgtggtcaattttggaataggtgtcgtgtggtgctgaaaagaatgtatactctgttgatttggggtggagagttctgtagatgtctattaggtccacttggtgcagagctgagttcaattcctgggtatccttgctaactttctgtctcgtttatctgtctaatgttgacagtggggtgttaaagtctctcattattattgtgtgggagtctaagtctctttgtaggtcactagggacttgctttatgaatctgggtgctcctgtattgggtgcatatatatttaggatagttagctcttcttgctgaattaatccctttaccattatgtaatggccttctttttctcctttgatctttgttggtttaaagtctgttttatcagagactaggattgcaacccctgcctttttttgttttccatttgcttggtagatcttcctccatccctttattttgagcctatgtgtgtctctgcacataagatgggtttcctgaatacagcacactgatgggtcttgactctttatccaatttgccagtctgtgcttttaattggagcatttagcccatttacatttaaagttaatattgttatgtgtgaatttgatcctatcattatgatgttagctggttattttgctcattagttgatgcagtttcttcctagccttgatggtctttacaatttggcatgtttttgcattggctggtactggttgttcctttccatgtttagtgcttccttcgggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggtccccactctcttctggcttgtagagtttctgcagagagatcagctgttagtctgatgggcttccctttgaggggtaacccgacctttctctctggctgcccttaacattttttccttcatttcaactttggtaaatctgacaattatgtgtcttggggttgctcttctcgaagagtatctttgtggagttctctgtatttcctgaatttgaatgttggcctgccttgctatatttgggaagttctcctggataatatcctgcagagtgttttccaacttggttccattctccccatcactttcaggtacaccaatcagacgtagatttcgtcttttcacatagtcccatatttcttggaagctttgttcatttctttttattcttttttctctaaacttctcttctcactttattttgttcatttcctcttccatcactgataccctttcttccagttgatcacagcggctactgaagcatctgcattcgtcacgtagctctcatgccttggttttcagctccatcaggtcctttaaggacttctctgcattggttattctagttatccattcgtctacttttttttcaaagcttttaacttctttgccattggttcgaatttcatcctgtagctcggagtacttttatcgtctgaagccttcttctgtcagctcatcaaagtcattctccgtccatctttgttccattggtggtgaggagctgcattcctctggaagaggagaggtgctctgctttttagagtttccagtttttctgctctgttgttttcccatctttgtggttttatctacctttggtctttgatgatggtgatgtacagatgggtttttggtgtggatgtcctttctgttttttagttttccttctaacagagaggacccttagatgcaggtctgttggagtttgctagaggtccactccagaccctgtctccctgggtttcagcagcggtggctaccgaacagcagatgtgggtgaaccgcaaatgctgctgcctgattgttcctctgaaagttttgtctcagaggagtacccggctgtgtgaggtgtcagtccgcccatactggggggtgcctcccagttaggctacttgggggtcagggacccagttgaggaggcagtctgcctgttctcagatctcaagctgcgtgctgggagaaccactactctcttcaaagctgtcagagagggacatttaagtctgcagaggttactgctgtctttttgtctgtgccctgcccccagaggtggagcctacagaggcaggcaggactccttgagctgtggtgggctccacccagttcgagcttcccagctgctttgtttacctaatcaaacaactaactcagcaatggtggcgcccctcccccagcctcactgccgccttgcagctggatcttagactgctgtgctagcaatgagcgagactctgtgggcgtaggaccctccaagccatgtgtgggatataatctcctggtgtgccattttttaagcccattggaaaagcacagtattagggtgggagtgacccaattttccaggtgccgtttgtcacccctttctttgactaggaaagggaattccctgaccccttgtgcttcccgggtgaggtgacgcctcgccctgctttggctcatgcacggtgcgctgtacccactgtcctgcacctactgtctggcactccccagtgagatgaacccggttcctcagttggaaatgcaaaatcacccgtcttctgtgtggctcacactgggagctgtagaccggagctgttcgtattcggccatcttggctcctcctgggtgtgtcttgttttctaatgattagattatggttatgcatttttggcagtggcatcacagaaattatacaccgttctcagtgcattgtatcagggggcacatgatgcccacatgctttattcgtgaggatgttagcatggagcacttgattaagagagtatcttctagattactacactataaagttatttttccctttttgtaaaaaatatatattttggggagggataatttaggctttgcaaatatcctatttcttctcaaacttttgtgcactaattttatcatccatccataattttcttttgtatttgaatgttgattttcctatttctctcttgccttctgtatttgtcaattagaattcttctctacagaagagctctatttcagattgttctatacatagaattatgcaatatgtagcctttggatttggcttcattctcttagcagaatgcatgtgaaattcatccatattttttgttgttgtgtaatattcctttgtacgcaagcaccctagttggtttttgtatccagtggttgaaggacacctgggatgtttccagtttgagtgattattgataaaacttgtataaacaatcacatacaggtttttatgtaaacatatacaatcatgcaccccataactattttatgtcaatggtggattgcacatacgaaggtgaagccatcggattataatggagctggaaaactcctatcacccagtgacatcctagccatcctaatatagtgcaaagtattactcacttgtgggtgatgatgctggcataaacaaacatactgcactgctaggcatgtaaaagtctagcatatacaattatacactgtacataatgcttgataataaatgactatgttactggtttgtgtattagctaactatacattttatcattaatttcagagtgtactcctatttattaaaaaatgtttactataaaacactatgtggtttatgccagcagcagcctcaggcatcatgtgtttactgcctcttgtttacatcgtattctcttgtgcttgatttaatcttgtgtggttttgtggcccctaaatgtgcaaaatccactgctaatgttgccaggaagaggctacattaagtgattgacttgcaaacactaaaggtgattaaagatgagaaaattggaaaatcactgataattgttgctcaccagtcaggcatgtcccattccaccatagctatgatcttgaagaataagaacaaaatgtcagaatctgttaaaggatctgcttcattggaggcagcaagactaacaaaacttgaagaagggcctatatcagatgtgaagaaacctcgaatgactctggattgaacaccagacacagaaatgtagctctctcagaaccctgatcatcttggccaaagcaaaaagtttgtttacaatgttgaaataaaaggctggtgggcattgtggcacacacctgtagtcccagctactcaggaggctgaggcaggagaaaaactggaactcaggaggcagaggtagcagtgagccgagcatcatgctactgcactccagcctgggcgacaaggcgagactctgtctccaaaataataaaataaaataaaataaaataaataaaataaaataaaagtctggacccatctatgttgaatttcctgctagctctgggggcttaaaaattcaataatcattattcattacatatgtgaaaatgagagtgagtggtgagtctgtgagtgttcatgtaaaagcagctgaagaatttttgaaaactctagataagctgattgtgaaggaaaattatttgccaaagcaaatctccagtatggatgaaacctccctattctggaaacagataccagaaaggactttcatctgtaggaggccaagtcaattccaggtttcaaggcttttaatgacaggataacagtcttgcttgggggaaatgttgcaggctaaaaatcaaaacattttatgatctctcacagtaagaaccctaaagtcttgagcatatcagtaagcacagacatccattttactgcagggacaataagaatatgtggatgacccagtccctcttccaagatgccctcttgaattgctatgccagcaaaatggagaaatgctgtgtggaaataatgtatctttcaagatgttgcttattgttgataatgctcccacacatccttttttttatttgtgatcttcatccccatattaaagtggtgtctcttcgtccaaacaccaaatctttaacccaactaatgaatcaaggagttaatagcttttaaggcctatgacctgagaaggatctttgttcaggctattgcagcaaccaaggaaaacactgggaagacactgatgcaattctgcaagaattaaaacatctctgactgcatcgagagccttgcttgggcttggaatgatgtcaccaagaagtatatgaatggtaccaggaagaatacattcaagaaatagagggggaaatcctgtgtgatattaagatgggggtatattaagatggtgagaccatgatctgttgaggacctactttattttatttatcttggtccctaccatattgctaaacacacattaagcagtaagtacatatagatgaaggaaaatgtcaataaaagacaaaaaggaaggaaaggagaggaaaagagtgaaaagaaaggaaagaaatgagaaaggaaaggaaagaaggaacctaatttttcaaggacttcaagctcaattctaaattttaacactttctaatgtcagtcacatttatataaaattagaagctcttctcataattgtgcttctctatacttttgcaatttctcctacctttgtgcagcaatcatattttagctgtgtttctcctctgaacttttaactctctatattataattatttaggtacatgcctttctacatagaccagaatcaacttgaaagtaagaccacagcaaattcatctttatattcccccacattatctagtctgtatcttgtattttatggcattcaatcctagttgtgaaatgaatacagaaatagagcacagtcttctgttttctgggcctgagaagtaaaagtaggcacaccttagtccacttgtgattgagataaagcaacagaatgatgtaaattcattgacattttcattgggttatatcaatcactgttggtatatttattcatttttctctcatcacaattgtcaaacaaagacatcagtgattttttttctcctttcatttacatgcaattgctgttttgggattcttagccctgaaaataatgtgttgacctttctcctgcacattaacaagcatgattcttttgaaataggtttagtttttattctagcatagccatatattatatataacatgctgttgtgtttagtatggctctccataaatacaacgagctatagcacctctgtgactttgtcactattttatatacctaatggctgaactattccattacactgaaatgatagtacacaaacatgtcttccattagctacagtttctgtgatttaatgatttatttaatatagagtatatctcattgcaagaaattccaggacattctctggggaatacaagtctggaaaggaaatacaaagctactggagggacttgagcaaagaaaaaggctgcttaaagagaataagaatcaagagagaatatactgagatttcttagcttgttccccaaatggagaaactagttatttccctaaaagaggatatataattaatataattacttcttatatgtcagctaaataaagttgctaaaacaaaaacaaaagctttcctcatgttaactgtaatgtttcaaattattcttcttaaatgaaacaatgttcctaggtcatagagttgattgctaacagactcagaaaatatttcacacaagctacctccacgcagaaaatgtggaagactgtgtttatcaaatgatgaaagttttaattacataacatgtaaatgtactatttttataagataaaacaaaataatgctactggttctttggtgtagtctccatatctttgctacagaaaaaatcttaattgctaaggaggcccagccttcagtctaattacaggcatctacttcttttcctaattaagaaattgagaactagccaagaaagcagaaaggaaacacaggttggcagggaagttggcctgaagggagaaaacctcttgctaaatcaagtttgaatcccatcaatgacttagaaagaatctagttccaaatataatggaatgaggagtgtattttgtatgtgttaaagatatctctcttaaaataggcaacatctctcttttaaaaaaggacatattatccagggacattatgagaaaagtcatgctgcagtttagaaccttgataagccaatcatggaaaaacaaaacaaacctacttcaaatggtaacctcagtggttagcattaaagaaaggaattgcagtaaatactagttttgtaatttccaaattttgtccataaagcacctcttcaatgacacagaaataataaaatacaaatatctagttttaaattgtgtatactctgattttgtaaagtaataacttattagtttttgaaaatgtttcataacaatatttttcttctctgaattgagccttgtcttacaaaacattgctcataatggtcagattagatacaattacatgaactgattagagaacatattaatgtctactttgtgattcactagtgtcttggattaaagaaatatttcctagacaaatgcaactacctcataattgctcatcctgccttcagtcttgcccctaccacaacccattcttcacttttgcagccggattaatctttatacaaaaagttttgcaaaattcttaggaaaaacaacaacaaaaatccagtcttcactttggcatatgagatgatctgtatcctgcttacctttcagatgtgatctccccttcacccctgctaatccacaatgccccagaccagctttgtgccttctacaagccaatctctctgttgctttggggctttcctgtgttcttgttgattgccctgaccttccctcatgtcctcacaaggctgtctttcaaaaacctacctaaatctaaagtagccctccccaaccccagatactacttattttatatgttttggataatttatgaagaaaagagatttaattgactcacagttctgcatcactggggagggctcaggaaacttacaaccatggcagaaggctaagagtaagcaaggcacatcttacatggctgcaggagagagagagagagagtgaggaagtgccacactttaaaaccatcagctctcatgagaacgcttcactatcaagagaacagcatgggggaaaccgcccccgtgatccaatcacctcccatcaggttcctccctcaacatgtggggattacaatttaagatgagatttgggtggggacatagagtcaaaccatatcacattgtatcctgatggatgggatactctggtcaggatgtcacattgctctccctaaggaaggagagactgacaagactagcttggaatcatcatgtggcatttcccaaaaggaaggtaattgatgtctactgtatggctttcataaaaatctctagaaacataatttctttggttttgatacttataactatttctgtgtttgtatgcatcatctatatataacaataatataaactatcagccttgtttatgattcatgaaataactaagaggatgggaaaaagtcaaatattttatgaaagaaagtacattattaacagcaacaacttagtgtagccatggttgtgttgttcattaactgcaatttagttctttttcaatagttgcttataaatggggctatgaaaatgaatggatttttttttctttttcttaacttctatttgaacaaaacaaaaagtataagaagtgaaaatacatcataaacctgctgttaaaattattattaaaggtaaaatctgattatccttctgccatccagttgtattctctagagctaacccttgttaataattcagagatggacttcctaaattttccataaaggtttgtagacacatttatatctacacttatatattgttttatgaacaaaaatggaatcatgctatgcaagttagttgcaattttttttaatttaacagctatttcttttaggtttgactatgagtaactgaacaactagaatcctggcttaaaataagaaagaaacttgtttcttgctcacataaaagtctaaatggcaatacaaagctttttggtgggtccataatcagggggtggccaggttccttctatgtcatttttccactcttttcaacatagaacttcaaactcatagtccaacatgttgtcatagttccatctatcccgtccgcccaacctccagcctcaggaggtagaacactgcttgcaggttacattaagaacagttccttgtgtctgtacttgagaacagacacaagggaggctgggaaatgtagtctgtatcatggtggtcatgttttctgtttcttgcctttttgtatgttctgatgttttgacatctaagacttgctaaacttggagtgactgcccctaccagggctgcccaattccagagataacaaagggctcacctgtgagtgtgcctttttttttttaattattattataccttaagttttaggttacatgtgtacaatgtgctggttggttacatatgtatacatgtgccatgctggtgtgctgcacccattaactcgtcatttagcattaggtatatctcctaatggaatccctcccccttccccccaccccacaacagtccccagagtgtgatgttccccttcctgtgtccatgtgctctcattgttcaattcccatctatgagtgagaacatgcggtgtttggttttttgtccttgtgatactttactgagaatgatgatttccaatttcatccatgtccctacaaaggacatgaactcatcatttttatggctgcatagtattccatggtgtatatgtgccacattttcttaatccagtctatcattgttggacatttgggttggttctaagtctttgctattgtgaatagtgccgcaataaacatacgtgtgcatgtgtctttatagcagcatgatttatagtcctttgggtatatacctagtaatgggatagctgggtcaaatggtatttctagttctagatccctgaggaatcgccacactgacttccacaatggttgaactagtttacagtcccaacagtgtaaaagtgttcttatttctccacatcctctccagcacctgttgtttcctgactttttaatgattgccattctaactggtgtgagattgtatctcattgtggttttgatttgcatttctctgatggccagtgatggtgagcattttttcatgtgttttttggctgcataagtgtcttcttttgagaagtgtctgttcatatccttcacccactttttgatggggttgtttgtttttttcttgtaaatttgtttgggttcattgtagattctggatattagccctttgtcagacgagtaggttgcgaaaattttctcccattttgtaggttgcctgttcactctgatggtagtttcttttgctgtgcagaagctctttagtttaattaaatcgagtgtgcctttcatatgcaaaccacccacgccaaagctcataggtcccaaaccacctcctttactgagctctaatacaccaagctaatattaccctgtcctaatcaccccaggtataggaaaactagggccagcccctacattctgaagcccactgaaattattcaaattatccaaccttaaacctacttagcctgcttacaccctgcttcacccattccttcctgaaaaaaccacaagagaggattttgtccaagttttccccacactctctgccttctgatcaatcctggtgcttcctcgtgtgacccttttgtttctaaagatctgtgaatatgaaaacttccttcatgactgtcattttcaagtatgtatgtgcattagtctattaccatgctgctaataaatacatacctgagactgggtaatttacataggaaagaggtttaattcacagctcagcatggctggggggtcctcaggaaacttacagtcatgacaggaaggggaagcaagcatgtccttcttcacatggcacagcaaggagaagtgcagagtgaagcagtatggaaaagcccattataaaaccatcagatcttttaagaactcactcactatcttgagaacagcatgagggtaactgcctccatgattcaattacctccaccaggtccctcccaggacacatggggattatgggaactacaattcaagatgagatttgggtggggacagagccaaacaatatcagtgtgtcttactatacaggttcaaagcaaatcctgagtgcattttaaaacattactaggtagtgatcattgcacaactttgtaaatctactaaaaatcacagaactgaaaatcctttaaaacagtggaagtttatggtgtgtgaatttatatctcaattaaaatttttaaataaaacgattatttctcttaaagtataaaaattaaataatggatattatggggtgataacctctgctaaaactgtgttattttccagattagtatagtacatacaaatatttctcttttatttttgtgtctgccctctattatatgagtgtattctcttttacttaacctttcaatctattgaaactatgctataatttatatccaggtcatacttttattatcataggatagattcatagaagtgtaattcatgagtcaaagaatttgacatcagtttgtgatttcacatcacaaaggtcatgtgattttttttaaatactgaaaattactttccaaagtgttgtagcaatttagaattcttctgaacgaataagagtgcccattgattttacttagctgtatctgctgggtatcattttaatattttccaatacaattatttgtaaaagcacctgattattgttttaatttttataacttgactatgtgagatgcctggcattattttatatgttcattagccattttcatctctttttctgacaattgcctgcttgtgtccctagctctttattggcctgggatatagaacctattattaaccagggacattaatattaccctaccatctctatctggaaatgtataagatggtctcttttatcttatatgttcccgatatatgtctaagaatatgtctttttaatattaattctgaccagcttgccatgtatccctgagaatagaaaactcactttttctccacttcagggtagttttcttcagttatttctttgaacattactcctcctcatttttatttctctcctgccgaaactcagagtgtgcatgctagatatgctgaatctatcccctttatatttcataccttcacacaggagtttccattctcctgtgattttaagatagcttgtgcatatgttttaaaatgagcattgagttttaaaaaattttctttaggatgttttcctttttctttcttaatatctcattataatcccttaagaattctcatcacacatttttcatgactcatctattctttagctatatttgctttcaaggagccacctgctctggtggttcagctcagtctcctttgatcaactccacttaacttttctttgtagacacaagatggagggttccctaagcacaggggcaggacaagtaaagtagatccggcaatcaatataaataagattaataaatctaacatattaataagattttcttttctagtgttgaacctttctactgaaacataggcatgggtagaggaagacaggccatttgattcctaggttctgcacatgtgaggtggatggaagatccttttccagctgaaggcatatttgtctgtagcagaaatgtcaggctttcccatatccacaggcatctagctgaaacagaacttcccctcttgtgatatggtcatatactcagctactgggcttccaaagacagtctcaggattgacagttttcatctcagtttctacctaaagagtcaaccttctaccaggcccctagctactttccattcagtcaatgagtaaatcttctgagacattatttactgttttcccttcatggttatttcctatctctcccaatgctatgagtgttttgtctttccccctttcccccattctctatactttctgctacacctccaccttctacatatataattgtctctatgcatgcatacacatgtataaggaaatattaatgtgtttcagaaaataaaatagaagtaaagcaatacttgaaaagtgtgtgataaaatatgtccaggcctttaaactcaagtgcttttaggaagcagtacaaggtgtcaatatatatggacaatctgcatgtaatatttgatatatgttaaataaaaataagtgtcatggtccactgtatccctggacttacaaagaaaatccagagttagaacatgaatgtctttgttatattgaacatttctacacatactaatgataagccaaaatatattatttatacactttaaaacatttgttttacagaattaaaatagtgcttattgataacttatataaattgccagtaaagtaaccaatatgtgtgagacatgcatgcagttaagaacaaaatatgtgtcatcatttaaaaaatattggaaataacaatttattttcaatgagtgcatagcatgcataaagatgaataagaaactttgaggacttcagagtaagtagtataatgatgacaaaaggaacttttccaaaacaggtagaattaaaacaaactgctagtattaccaattttcacaatacacataaccagcattacaaactatacataaccattaataagggcaagacaaaaacttacctcactcccataattctactgaaatcatagtggcagtgcacaaaatgcaatgcatatgaattggcattgataataacaggagagaactctagagattttggtgaatatgtgcaaatagaaagtgaattgttttgaatgggttgatgaaccagaaaggcaggacatacagctcaaaaaatccacaagaaaaacagttgggagccactcttctagaaacaaagaaattctgaatcagcagacagaatggaactaagaaggcacaaagaaatcagagtgactgagtggaggaatttctaccaaacctgtgttgcctaccctactcacttctttctcatatttcagagccactggaaatgatgacatatatcctcagggcaaaaggggaagcaggctttctaaagaagtaaatcaaggtacctgaaaagcaatagagctaatgtgtatgctgtcacacaagagtgaagcttccttattttttgcatggatagacttgcttgtgcaaatccattaatgcaccctaaagttaaaactgccagccaacagcccttagtcagctatctcattaagggatgcagctctagagatggtgaagagacaataaagtttaccatattttgattaaaaggccacaaaagagaagtaacaaggagtaaaaacaaaactaatcaccataaaatttattcagaaaatgtaagaaaacccctttaaaaaattctatttgatgttctcaaagagagggggaaagatactgcatccataaaataagaacaggttgccattaaaaagaaaaaaaagaaaaaaatcccagccaaactatctagagtgagagtcaaaaaataaaaaccaaagaagaactgtttaaacatgtgcaggaataagaaactctgttttcctgaaatcatgattgaaataaaaaaaaaagaatccatggaatagaaagttgtggattttcagaaaagtgatatataagcacaaagaaaagaaattccaggagaataatcatgcaaagtgccctgagaacgattgatttaaatcagaaatatagtcttaggccttcacaagagtgtatttaaatataagaacagtatgggttttgttcaacagatagtgtgattgtgaaactagagcatctaaaggtagctactaggtacatgtgcttactgagatttaaattgaaattaatgaaacttaaatacaatttataatttggttcctcaggcacactagccacatttccagtgctcaatagccacatatggctggtggctactgtattggacaacacaaacatagaatattttcatcattgctgaaaattggagtgaacagctttgatcttggtgatatggtgagcttattgctttcattcattcttcaaagaatattcattgagtagattcattttgaagaaaaggacaaactgagaatatagcatctataatgagtgagtaaaggccttgtccttctatggacgtagcatctaagagaaagacaataaacaaatacagggatactcatttttattgcatgcttctttactgctcttcacaggtattgcgttttttacaaactgaaggtttttggcaacattgcattgagcaaatctatcagtgtcattttttcaacagtatgcacttacttcatatctctgtgtcacattttggtaattctggcaatatttaattttttattattattacattttgatattgatctgtgattgatgatctctgatgttactattataacagttttgggatgccatgaacaatgcccatgtaagatggtaaacttaattgatcaatgttgtgtgttttctgactgttccaccaatcagccattcctccatttctctctcctcaggtctcactattccctaaggcacaataagattgaagttaggccaattaataaccttacaatggtctctaagtgttcaaatgaaaggaagagtcgcatatctctggcgtttaaatcaaagctagaaatgatttagctcataaaactcagtgaggaaagcgtgtaaaaagctgagattgactgtaaactaagcctcttgtgccaaacagcccagttgtaaatgcaaagggagtattttgaagaaaaataaaagtgctactccattgaactctacaatgagaagaaagtgaagcagccttattactgatagggataaagttttagtggtctggatagatcaaaccacaacattcccttaagccaaagtctgatggagagcaaggccctctcttcaattctatgagggctgagagagttgaagaaactgcagtcaaaaattttaaagctaccagagattgctttatgaagtttaaagaatgaaaccatctctgtaacataaaagtgcaaggcaaagcagcaagtgttgatatagaactgttgcaagttatccagaagatctagctaggataattgatgaaggtagctaaactaaacaacacattttcaatgtagttggaacatacttctattggaagaagattcttctagaaatttcataagtagagagaagttagtgtctggcttcaaaccttccaaggacaagctgacttttctgtaggggctaatgcagctggtgactttaaaaggaagccaattctcatttaccattctgaaaatcctagggcccttgagaattatgctaaatctactttgcctttgctctttaaatgaagcaacaaagcttgcatgacagcacatctgtttatagcctggtttactaaatattttgaggctactattgagacctactggtcagaaaaaaagattcttttcaaaataatactgctcattgacaatgcacttagtcacccaagagctctgatggagacatacaaggagattaatgttattttcgtgcctgcttagaaaacatccattctgcagcccatagatcaagaaggaagttttgactttcaatgttattatttcggaaaactacatttcataaagctatagctgccttaggtagtaatttctctgatggatctggataaagtaaattgaaaatcttctggaaatgactcactatttttagatgccattaggaacatctgtatttcatgggaggaggtcaaaatttcaatgttaacaggagtttggaagaagttaattccagctctcatggatgcttttgaggggttcaagacttcagtggaaaaagtaactgcagatgtggtggaagtcgcaggagaactagaattagaagtggagcctgaagatggggctgaattattgtaatctcatgatagaactttaatggacaaggagttacttctatggatgagcaaagaaagtggtttcttgaggatgaaatctactcctagtgaagatgctacgcacattgttgacagtgcaacaaacatcaacttagttgttaacacagtggcagagtttgagaggaatgactcccgttttgaaagaagttcttgttgctgtgggtaaaatgctgtcaaacagcattgatggttcaaagaaatctgtcatgaaaggaagagtcaatcagtgtggctagctttattgttgtcttattttcagaaattgccacagccaccccaacgttcggatacatcagcagccatcaacatcaaggcaacaccctccaccagtaaaaagattactacttgctgagggctcatatgatcattagcagtttttagcaataaagtgtttttaattaaaccaaatacaaaatatgtattttgtatttttaggcataatgctgttgcacacttaataaactacagtatattgcaagcataacttttatatgcacttggaaaccaaaaaaaattcattcgacttgctttattgcaatatttactttattgcagtggtctgaaaccaaacccacagtatctctgaggtattcttgtaatgcgtaatataatataatggattgacagctgccaaaaggaaaaacaaagaagtataaagttatgttgaaggtgagggctggagactatttgaagtcggatgtgaggaaaggcttattggagaatttgatgttggagggacgtagaatgtcctgtgaaaatctgtgggaagtatactccatgtaaacagaaagtcaagtaaaaacatccctgaggtggaaaaatgttgaatgtcccacagaacttcaagaaggctactgtggctgaaacagccaataaggagcattgcagaagataaggtcagagacgtaaacaggaggtagatctcatagggacatatcagcaagagttaggatgtaaaattttatcccaggggtgatgggaaatttttgaatggagagtgacattatcagatgtatacgttcaaaccatcactttagcagtttttgtggcaaattaatcttaggagtgcaagagcaaagtaaaatttatctttaaaagctttagaaaaggtaaatatatttaccagaaagttcctggtcccaatatgaaacaaactgaaacttacagtgaatggagtataagaattaagcattatttaaccttgaggtccaaaacattctcctttaatggacatgtttagagatagacttgtacttccttctctacaaattaattataataatgtttttcaacaaataatgtttatttaagccaactattacaaattctgtttattagtatcaagtgtttagaatcacactgtaagcaaagaatgaaacaaaatcaacttaatagttacaaatatgagtttatacacatttaaaagtaattacatagctgataattcagaagatggaggctaataaagggacatgaaatgttttcatctcacatagtgaaatgttgatggagcaattaatagaagtgtgaatatgaaaagcgttaagttaattagggggaaaactaaaaataattaataaaactaataagactcaggaagaagtcagtaacttaatagggagtcatttgattctatctaaatctgataaattaagaaatacttgtaaaaacattatttattattataataattctcacaagcacaaatcataagtgtacaaaaaaagtttacctttaaggagcaagaagtttgcatgggctggtagaccttttcattgttgtttaataccattctgaagtattgcatttacaagtatgtgcttgccatattttataatagtcataataattctgttatgtaaaacttgtaaacagaaaatatgttgtattgttgatatcctattgtaaacattacacttatttttttctcacaatcaaatttaaattgattgacaaaatacacattttagatgctaaattaaagggtcaactttattaagggtcgacttttaaagaaacaacaaataaccaaaatttagaaatcacagagtattaaaaaccatgacagatcatgacacaaattgccatccaacatttttttttcctaaaaggtaaacaacatatacaaatggattgtatacatgggaaaagaaaagaagatgtgaattgcaacattttgttgggtttgatacatatggagatttattattaaacatgcaaaatctctgaggctaatgttaaattgaaaaacaagttgtcagcagctattatacactctaaggccaattgctacataatcagaggtcgtaagagaatgaaagcttaggcatgtttcaagtaaatatctggcatatatggcacctcggtagcagaaaaaacttaaaaatataccattctattcccaatgtcagaaaagggaatagaaaatgaaggatggaagtaactctcgccagcacagagatgatatccacaatattcaatccatataccaaggggaaaattttttacagggaagtaataaagatcagaatcgagtctagggagttttctgccaaaataaataaaaacaagagaatttagtttcacaagcacagaaagaacagaataaatatcaaaagaatctgagccatcagaacagcaccttcaaggctcctacattaaccagatgtcatgatttataaatcacatgctataaatattcaaggaaaattagccccaagaaaaaaaaaagcaattatgcatttgtagtaataacagccctattattacagatgataattatgatctatgattacagtttttgtaaagaggaatctatgttagaataactatgtgtatgacaaattctgaagaaaaagttttaaaattctgctttctaaatctgtgacacatcatagtcaagaagcactaatggtaactgaatatcaaaatgtaccttgagtggattaaatattagtataataaaatattggaattcacaaattaaaaatacaaatatatattttctcaaatgtattaacattttaaaatttcaagttcttgccactgaaagacctcacaaagacaggaagagtcttgatagaatctaccaagtaaatactggaagataattttagctcttgtattagtcagctttttgcattattataaaggaatatctgagacaggtaattgataaagaaaagagatttaggccgggcgtggtggctcacacctgtaatcccagcactttgggaggctgaggcaggtggatcacaaggtcaagagatcaagaccatcctgagcaacatggtgaaaccccgtctctactaaaaatacaaaaattagctgggtgtggtggcgcctgcctgtagtcccagctacatgggaggctgaggcaggagaattgcttgaactcgggaggaggtggaggttgcagtgagccgagatcatgccactgcactccaggccggcaacagagcgagacaccgtctcaaaaaaaaaaaaaaaaaggaaagagatttaattggctcacagttctgcgactgtacaagcatggcaccaacatctgtttggcttctggtgagagtgccaggaaacttacaatcgtggtggaaggtagcaagtgcatcatgtggcaagagtggtagcaacagatgggggaggtgccacaattttaagcaaccagatcttgcatgaactaactgaacaagaacacagttatcaccaagggggtggtggtaagccattcacaagggacgtgcccccattacccagtcttctcccatcaggccccacctccaacattgggaatcacattttggcatgagatttggagggaacaaatatccaaactatatcagtactcaacctatctggtcaaatccctcaatttcattgagaaaactgagactctaaagaatgtttctgctaaaaatcatatacttgttgctaatgctaggattgtatgagtagtgctgctttgggatccaatcttggaaaatattgacttgaagtcaactttatgtatttattatccaggtttatttacaaaataattttgtcagggctctgttagtgagaaatgttagaaacccaagtcatgctctcttaattcaaagagagtgttttggctcttgtcactcaaaatccaggatcatttagctgcaggtatggctggatctaggattctttgaaaagactttgttgctttcagtctattggctctgctttcttcaataatggctttactatccggtgagctttttctatatggacaccttctgtatcttgaggctaaacatctaccctattcaattccaatgagtaatagtctttgttccctaatagttgaaaggaagtcctagaattgaaccttattggcctggcatgtcataggtccacctctggaactcaacaggaatggaggagtagatttaaactccatccctaccaaatagaaaccacatgaactgacagaagggaaaaggtgatttttaaggaaaatcaatgtgctcttccaagaccacagcaaaagcagatgtctagtattttcggttcattcatgttttattctacaaatgatttcacatctggcacacttattgttgtagtgtagaaagagcattgggaatggaaacaagaagatctaattgtatggccttgagtaagttgctaagcctttctgagtctattttcctcatatgtaaatcattttaaaaatatattcatcattgcaatcctatgaatgatttgaagaacaaaaaaaacttggcaaataaaggcttgtgtgccaaaaaataaatccaggcctgccacattgcacaactttgggggacatcattggcatagaatacaatggaaaaaaaaatcaatgttatctataaaatgggctaataatagctcttttacaaagatttagcctgaaaacattttgagagtgtcaagcacagtgttggccactgttatggatttaattgtgtgcccccaaaagttatgttgatgtcctccccaataccccagaatatgaccaatgaagtcctactggagtaaggtgggacattaatctaatataactggcgtacaaataagaataaaagagagagacacatatggaggagagcaccaggagaaacacagggtagagatcgaggcagagattggactgaattatccacaatacaaggaacactaaggactacctcttacccatgaacgtgcagccacaagaggcagctcaggaaaacaaactttattatactcacaggtcctgaagacaggaggcacagcaagctatgcaaggcctcctgggaaactcaccagggtgctcaggaggcagaagacaggagcaaggagaaggtttaggccagagtgggaaagtcatggcagagcagtgaacagtttaggattggtatttttaataattttggtgggctttgggttataagggtggtcccttgttgcctggcacctggccctggaatgattaagaggagaaaagtcatcatttggggtgtataatctaggtagaggaggtttggctctggattggttagtttacgtatcaaagacttgctgtaagcctgggccctttgctagctccaggttttggctaggccctggaggataagtctcttaatagcgagaatgatttttaacatgtgaaatcatcataacatgcaaaaaatttaaaaaatacttataatatgctaaataaattacatcaatcatcatttctttccagaattacagagaatcacactgtattcctacctccatttttgttatcctccagttcatcctatgcactgccgtaggagtgatctttataaaatgcagaacagataacatgacaccctggcttataaaacttcaaggttccccacagattgatggaacgagtccaagttctttggcagaatattcaaggcccccattgatctggcacttgcttcctttctaggatcgtttttgctaattgctgtgcctgcttcagttctattaaaccatctacagctctcagagagcaccatgctcttcagagcagctccttatgcctacaatgccccttttttctttcccagtggtaaactattgccctttttaggtttaatcaagacttttctcctctatgtagaatcatgagctcccttttttccccactgtagtctactcaaatatctactgttacaagaaaagttattcatgacacttgttaaagatggtgaggcagattttattcaaggagggctatgaatgtaggtatagggaccagttccacaggggtcttgcagtgggggagagaaatttgacttaactccaacaaggacaagtggggatgtatataaccaaggagcagagtggatgtcatcggatggaaactattaataggaaacatcaaggctaagaagtttctggataaactgacttgataggattgttgctgaagacagaccagggtaataagatattgaaaacagtcagacaccaagggtaggagatttttgctaaactggccagtaggatttttgctcagactgcattctataagaatagatatgaaggccccaaatcaagtcaggtcagaaagggcttgggagcctactaaagttctggtcaaatgagtgagtctttgttaccaccatagctcctaaaggcactgtgttgctattattattttatatgcatttgtcttcccaagtacacataaaggcagagattctccatgatgtatctcaacatatagcacataagtgttcaataaaagcctattaaattaatgaataataaaaagataaagtaataaatgaataatcaaatgttaaaaataaatagtgaatgagcccaacagtctcccaatgaagtattttacttaaaagttaagaaatgcttgattttgtattcattggcagtgattaaaagaacagactctagggtcaagctgcttggattcctagcttaaattacttatttaggtgactttgggaaattattacttctctgcaaaactcaggatataatagttccttcttcatttgggttgttaggaaaactaactgaacatatatttatattatgaaaattgtattgtgaagagtaaatgagaatattgtaattactatatacattttcaaaaaaatactttcaatgacaaaagattagaggcaaaactattgttttaattgaaagggattcttattctttgtgtctgcatatattgaaaactctgagcttaaattatgaacagtatttgtgtagtttctggtacttcagtttctaggatacacataaaaatgcatctgtttgttgaaaataacaaagtgctttttttcctggttcatgttggtcaaatgcctgctgcagtcagttttaacacccatggcttttctctctgtgtataggatgaagacccagagaggggttatgtaagtcaccatagttcttattgattcaaaccttgttgaattttacctaaaaacaaatttctcacgtgtagaatcgactcacactgttgccaggttgtactactaatttttatttttaattttattgccctaagaatatttatttttatactacccagctgccaccagagattttgtatcctaactacatacaattttgttttacagtaagtagaataaaaataattaaaataaaatattccaaatatgagggattcatagaagcaagtggccaggaaaactttatggagaaaaagagacatgagttgggattcagaagatgctggaaattggaacaggctagaagacagtatggaaggcactccaggccggagaagtggtgtcagcaagtctaagggcagaggcattcctgtattttggaggtggataacacctcaatctgccttaaacattaggtttatatgggggagggaatcagaatataaatttaaaaattactatggggctgggccgcggtggctcacgcctgtaatcccagtactttgggaggctgaggcaggtggatcacgaggtcgggagttgaacaccagcctggccaagatggtgaaaccccatctctactaaaaatacaaaaattagctgggcatggtggcaggcacctgtaatcccagctactctggaggctgaggcagataattgcttgaacccaggaggcagaggttgcagtaagcagagatcacaccactgtactccagccagggtgacagagtgagactctgtttcaaaaaaaaaaaaagtattatggaagctttaaatgttaaaccatgacattacaactctacacaaaaagaaatagaaagttttgaagatttttaagataataatgctgcctgaagcaggtggtgtgcagaattgcttggataagctagaggttaaattcaggcctgacttcaaggaaataatccccttccaccagcactgtagagtctagataccagaatgtagcaataggaagtcatcttcagagtgtgttgagaatgaaagggtcagcaagagaaaggtcaaaataaaatagttcacattaagagtcaggaaaaagaggagtctgaaactggaagcctaaattcaggaatggattctgggatggacagaagagggcatatagtgctgttattgcatataaacatatcacctatgtcacggcaaggagtcagcatttagggcagtaatatcacttgttaaaaaatactgctgccaggatggcctggaaactcaataagccctaatcaggaaagagtagaagcagagggaccaattagcagactcttgcagtagtcaaaattaagtgtaataagggccagaggtggcatggtagaaaaaagactataggggttgacacaaagaagattcaggagaaaaaccctccttaaaaaaaaaaaaagttttaaagttaaaaccctttcatttgaagcaattgcatatgttaggcaatttctccaaaatttaagtgctaattgatagattctgaagctgtcttgcaaggaagttcttgtacccttagaaaagtcattctctcagtgacctggttgctgcattatcatctcaaatgccatttttttcttactgtttcattacattgtcaccttcaaaggacaaaattacatgtaagtcataaatcttatttccctaagaccaaaagaaaatcttccttgaaactcataatgaaactctttcctgttaaatgccacacagcagacacacgttagacctgaattcttccgtattagactcaacatgaatttgctattaaatagcttttaactgagatcaaacaataagaacctacaaaagagcaaattctcagttcacaaaagactaattgccaagcttgcagcatttataaacatcaaggtcaatgtgaaatgtggaaggtcaatgaaacttgctggcaaagaaccatcattgcaatgtatagcacaccatcagcttttccatatacctctactgccactttctgtttataaaaccataaggttattttgatccatttttacttttttccctcagtcagcattctatgtatataatgcaagctatcttcatcttggcaatttatctatctaaagtagaagttttcttggaccaaaaatctatgttgttctgattaatgccagtgtcaactaaaacactgatctcttttcctttttttttttttttttttttgagacggagtctcgctctgtcgcccaggctggagtgcaatggcactatctcggctcactgcaagctctgcctcccaggttcatgccattctcccgcctcagcctcccaagtagctaggactacaggcgcccgccaccacacccagctaattttttgtatttttagtagatacagggtttcatggtgttagccaggatcgtctcgatctcctgacctcatgatccacctgcctcagcctcccaaagtgctaggattacaggcgtgagacaccgcgcctggcaaaacactgatctcttagttactcctttttcctgcttttttgtctttgttttatgctgatattttaacatgtttattggattataagtcactcttggtaatatgagcccttggtttggtaatagagtataatcatagtaaatgatactccacatggttcttggccttctgattcttagattttaagtctcagaaaagtatacaagtataacatatttttattttaggactcctctgtgctgtcgtatagctggctcagaagagaccaactttcctgaggtgatgtcttccttgtttccccattgtatgcctactatgtgccagatagtatgttatacctttcttatatgtagttttattaatcctcataaaaactacaggctaattgttataattttttcattctccaaataaggaaatttaaatcagaaatattaagtaacttattcaatatcaaacagcttgtaggtggcaaagtcatgaggcggattcatgtctgtctgactccaaagctcatgctctttgattacatttggttgaatttttgactttctgcctacatacgtcttaacaaaatccatataaaacatattttatcactatatgtatgacactcttgaattaagcaaaaggcaagaaaacagtcaagtttcttagtaaagaataatgctaaactcttattgcagctttttggtaacaactgtgtctgcgttgaataactatgtctccaaatgacttgatttgataattgttggattatttaaagtatggtgttaatgagtttctcaatctgcttcttatttgtgtacaaagagttcattatgcctgatgaaggcctgttagcaaaaggaacccaaaaaaataaatacaaagcaatgtgcctttagattatatgaagtcgagtaaaggtggtgacctggctaatacaaaaaagctaactgcattttaggttgctataatttgacaagaagaccatttttacaaaattaaagagttcttttatagtctactctgggcagtttacatctggtatacaatgatcagttccagattatacattttaaggtcagctttattaaggtataatttgtccaaaagtaaggtaaccagtatgatgagatttttatttattttttatttttttaaattttattttttattatactttaagttttagggtacatgtgcacattgtgcaggttagttacatatgtatacatgtgccagagatttttaaaataagtgtctgatagatcaagatatgtttagcctacagtcaaaaatttaggcagaaaatggaaaggaaaaaataggtctcttcatttatcatttgtattgccacatgcaaattcagagggcaaaattaagaccaaatgaatgaaagataaattaatgtttcctgaagacaaattttgtattgatttaatattaatcaagaaagcccagaataaaacagataggcacagaacttagtcacagggatgcaaatagaatagttccagaatgtccaggatgttcaggctcctcccaattctaagatcccttgcttgaatgatagctatgatattcttctttcattttatctattaacatgtatctgttatcatgtaatgtggacccagtcacttttcaccttctttctctttatttaagcaactcaaaaagaaagtttttatttcattggtttgagaaaaaattgtaatttcttcttggagaaatctaaattttattatcaaatagagaaatggttttaataccctatcctaaaggctgaatttataaagtcattcagtcagcaaacatatattgagcagctaatagaatgctaataccataagtgctgtaatatgtggtagttgaatgaaagaggcttagggcagtctcactggatctatttgaataaaagaaagtttcttacagggagtaacacttaagcagagtcttgaaggatgagtaaaatgtgggttagaaaggcaaagaaactgtgtattattagcaggaaacacatataagaaaaagctacacagatgtgaaagggaaaaggcttatagacctattagcattttcttattgtggatgtcaaagctgtgtgaagccagttttcagagatgtgaccagagagactgataaatgaaaagcaagcaatagagaaagggcaaaaggtagggaaaaatactgcaatatttgttaaacaaagactactatgaaattatataatgaattcttacaaatcatttttaaagaccctactatgtaaaaatgagacaaaaatatgagcagctaattttcttaaaacaaatataatgattaatgaaaataagaaaatatatatttaatttcactagtagccagtgatatgttaattaaaaccaaaattaaacgaagttttggaaataatagacactagggactccaaaaactggagggtgggaaggggaagagggttgaaaagctacctattgggtactatattcactatttgggtgatggggtcactgcaagcccaaacctctacattatgcaatatacccatttaaccaaccttcacatgtaccccctgaatctaaaatttaatttaatgaataaataaaacacaaaaaacaaaactagattacttttttaacctatctagtaaaaactgaagagagtgatactatctgtgttaataagagcataggaaattagaacattgtcatttactcttgataataatttaaattgatatagacttgtggtacactatttggaagtatgtttttaaatgcacatattgtttaactcaggaactccatatctatataactattctagatatatatgcaataacctaatactcatcaggaagaaaatggttggataaatttgtggttatatatgtactggtgaacattatgatgcagtgaaaagaaggaggtagattaacatcatgagaggtctccaaaacatgtaatcaaatttaaacattcaaaagcaagttaagtgcagtatatagagagtaatctcatttaccttaaaaattcacaaagtaaaactactcatttcatatctacgtatacaaccattcctggcataaaaaaacatctgagaggttacacatcaaaatgatgacagcagagggctgggattagatgaatgataaagggaattgtcattgttctaagttgtttaaatgttaataacgatagtttgtgtattatagtgtgatataaatcataagtattatttttaaatctgtggggagcctttgaaaggttttaagcagggaaatcacataggcacattcgcattttagaaatatttatctgccagctgaatataagggggaaatataagcacggaaattaaattggagacagggaagtcaataaaaagtgatggcaataatccagagtaaaaaatataggtagacttatataaagctgtgtaattgtagtgaagatagaagaaagagggtgactaagaaagacaggttttcactacatagaaaccacaggacaccaccagttgagattagaagacgactctgaggaagtggtctaaatgaacctcgagtttccaatttagcaactagctaaatggtcaagtcttttcatgaagataaggaacacagtgtggggagtgaaggggtaggctaagggaaatgggattcttagatctttgctaccctaaggaatttgggattttgaataggaaagttatctcaaaatttttctgtgaaatatttttttccaagaaaaattacctcttctctatagaagaggttaatggcaagtgagttctatctaaacatcctataaagcttcaagaaatttccagattttgtaaaaagttgtttattcattttttttccttgatcagtccagggagcaactacttctacttgtcatgggtatattaccatcgtgaaagaaagggtttatcaatgtcatccactaaagagttacacccttgccacctcccttacatcccactcatcaactgcgctggcagacactcaaaagctgggagaatattttctgtcaggaaggtctaagtgcacactggcatgtaaatcttgacaagcttgtattttgggggttagtgattattttttgtccttaagttgtctcaaggttgtagaacttaagtgaaagaaggattccatccaggcatgccagttgtttttctaagttcaaaccatactatctttatttaatctatagactttgttttactgttaaaagatgaaaattaaacctctttcgtgtataaaactgtgacattaaaattagattagagatgacccgtggaatgtttgcacttattaatcacaattcaaccttgaaaaaagaaaaagatttctattacataatggtagaatgtataagacaaaaaaaaatgaactcagtcactcatcagtttttaagtgtgaaaggtacaatgaacaagataacatgacatttgcctttgtggaaattataataatggtgaggttgtgatagcaaaagtgtgggctaatgtggaagcacatctcaaaggcacccacattggtagaaggatgacaagattgaggggactcttttgtttttcttttccatttatttatttagagacaagatctcactgtgtctcccaggctggagtgcagtggtacaatcatggcctactgcagactctgggctcaagcaatcctcctgcctcagcctcccaaaatgctgggactacagctgaaagccactgcatccagcctgcttttttcttttaaaactcttaaaatttgattgaaagtgaaattgtaaacgtagagttggaagttctggaactggaaaataaaattgcaaaggaagaaaagaaaatttgcataagacttatccaaagtaaacaaatctaaagatattgagagaaaaacagagagaaatgttttctacagtaaaaatttattcactattgaagatgaaattttcttttaatagtgaaggaacacaagccattgatttgtgaaactttctttccttcctttctctttctctttcttttcatcatacatctaagcatcaggcattgagctaagcttatgaattaaaaaaaaaatcccctgtcttgagagagctcacaaaaaattgtttccaatttttatgctctttagtgttatctccagggagttagaggcagtgactctccaggactcattacctattaaggcaatgctcttaactgtcaaggtacctcatgacataaccagttaaaatttttatctctagctattcacttctagataataggaaaagcaaaaatcaagtacaaattctcttaaaagcaaattaagaagttgtatataaatatcactcttaatcttatcttttccggttttttgtttttgtttttgtttttcttggttttttttgtagtggaagagaaggaagtagagtaatatttgggtctttggaagttatgtttcaatgtgacttcatttctcattcattttctgatgcagtgacagactgagaacaatccaggcagatgagtggcatctgggttggtggatagactcagaaataattgcccagatagagtaagaagaataggctagaacagccaaaattacatccatgaagtctgtttcaaaatctgagtatgagatagagtcatcagaggatattgacacagttaatttagggaccaggaatgctaaaaaaggaaaagccagactatcagcatagagtcagattctgttgtaagtgacagaaaaccccaaataaaaagtagaaaaattattcctttcacaaataagcaacatccagaggtaagcaatcaacagctagtaggatagcttcgtgaacctccgagacccaagatccttcgacatactgaacagctgtcttcagcacactgtccaggatggttgtgtaagttgcatttttcaagaaggaggaaggggcacatatagtcccatttcctcctttcagggatacttcctggaaattgcaaacactacttccatttccactcactgatcacatagcttcatctggatgagtaagaaagctggaaaaatatggtctttattctggccagccatatggcccttaacgacaggggttttgaaactgggatgaaagaaacaggtatggaaaggccactgtcagtctctgccaccatgagctcagatcatgactagaggtataggactttcctcaatcatcaagtatgaactgaggttgttccttttggaggataccttgccatgtactttaggggctgatttggccttttaaaaagattttttcagaccgaagattttcaaatagtagagattattcttacttttttaactagatatgcatcataaatttaaaaaatttcagggaactaaaacttctgtttcattcaactgaatttttataacagtcttatacacttatctattgtgtatgaatgtgttaaaaatttggtcagtcaatacttttaaatacaatcacacatacacacatgaatgcttgcccttatgcaaccatttttctttggtctatcaatatatgccattaacctaaaaattaatctcctcttcatttttatttcatgtttatttctcgacaagcctgttccactatccagtatttatgtttgccagcaattcttttctataaatacagtttgctagattatagctaaatctatacttaaatacaaactctctggcactttctccaaactcaaggtttgtgattataattaagcaataatattgtcacttgcttttttctttcttgaaagtacctaatctccttaggtatctgccccttagtgctgtaaagatgtgatttgaaaagtaagtttaaaccgttctttcaattaggctgcacttatttttatattcccagccttatacccagattacctggaaggtatatatactcagttaagacacattcgatctgaaatctatatgactttgagtataaatgggcacctcttaatgattgagattgagccaactgctcattcagctgaggtgaattaagtcttctagggcaccagtgtgccatttagtaaattacatcatccagcacactaaatgtgcctcgcatgggtgaacagcttccttccagggtgtactttcctccccctcattctccattgaccctaccttattgatgtcatagggtgattcatatgactcagtatttacccacagcctcagacaataagactgcaccattatttacaccactgcagaacacatgcgccagtatgtaaagggtaaacgagaaagttattttgtttggattttttgtaagtcaaatataaacaaaagagcatcactatcctctagattctgaaactgtaaaatatactgtcatatattgcttctcggccttttggctaagatcaagtgtaaatttaccatcatatagtaaaatggcttagccccttaaaaatatcaataaacaagcatcttttaaaaaaaactattaacacaacagtatgtacataaaacaagcctatttaaatagcagtaaaattgaatataatactttgaaagcgataagtttttatttttcacttgcaaatacaaatgttcttttaattttaactcagtcctattctcttagatattaaaactttagacatttattggatcctgttttggaaactaacatctagggcataaagtagtttttgtggtgccataatttgttaaataatactttgaaagtggctgggtgcccaaagagttcatgcagaaataaaatgcactcaaactgcttccaaatgttttcctctccacatatatcacatcagaagctgctgtttctctcacactgtcactatatctaagaagctataatcattcaccacccctagtggaacattttagcaaactactcaaatttacatccaagccaatgtttaaaattaaattaaaagcatgtatgttaagtgaaccaataatctaatgatacaggggtctgaaattgccttggaactagctctgaagaatacattaaggaggggcattttcaacagtgaacaacacctgcttgctttttatccctcactttttctcttgactctccttcaatattcttatgggacgggatgtatttgggtcctcattttgaactcagtttaatggcctttcaaggatagcctgatgataaacagagttgaaaatggtggcacagcaaggggctggaagatgtgaatggagatattattccaggcagtctcaacatgcccagttttaatgtgactaaacagtcataaagtcaggcttctttgagtctgtttccgttttctccctattatcaggaatgagtgttgtctcatatcagacttgagaattaggtgaatatacgcctcagtggcatccagcttacaaaaaggaatagcctcactaaaagttagaagttacttgaaactgtataatgcctgcctctttcaaacccatttcacacttatgatcttatttgaaaatagagcccaacacactgttattactttgcttcgaggccatagttgaggtgaaattggctggctcctatacaggagagttaggcctgcagagaatgaatgctaagtcagtctctcccctcatggaatagcatccctagctatgtgcctcccttgtctttcatgctcacataagcagtccaaattgctccaccctcaagatcgtctctctgtctgtctcttaaatacataaatgagaaggcacatatgcaaccctgggataaatgttgggaaggatatatgtggcccatgtctggctgtttgtattattcagtgttcaccaatctgtctgggagagaaagactatatgagatatcaagagggacttgacaggtcagaacatttttaggactcaagtgatattttcactatcttgcatgaatgttgtcattttacttttagaagtttaaaggaagtttagaagcaaaacatgggtacatgttgtaactcccatttttaaatgttacctttacaattaacccctatatgcaacatgccatgccaagttctattgcacgtattaaaatgagaagcttcttcaaataatttattgtaagatacatgaaaagaaatacctatactgcaagttaaaaatgtgataattttacacatgatagagagaaaagagccacagagaaaggtctattttgtgccaggcactttataaacactattttgtataattgtcctcataacatcaaatttcccacacattaccaaaatgagaactgaggctcggggagtttaagtgacttgcataaggtcatgcagcaagctatgcacagcaaagttttgaagctggatccctctggctccacacctgtgctcttcccattgcagctttgctgcctcctgagggagcacagatgagggcaagatgattccagcagcagacaaataaaaagcctcttagaagaggtggcatttgagcagcgtatttagaatgagtcaggccaatatggggtattctttctttgtgctagaaggagtgaacaacacattcaaataacaatgaatcttcctgtatgtttgcaggaaaatgtgaaggattctgaagctgttcttttttatttttatttttatttcattttattttttttttgagacagagttttgctcttgttgcccaggctgaggctggagtgcaatggcccaatctcagcttactgcaacctccacctcccaggatcaagcaattctcctgcctcagcctcctgaatagctgggattgcaggcatgtgccaccacacccggataattttgtattttcagtagagatggggtttctccatagtggtcaggcaggtctcaaacccctgacctgaggtgatctgcccacctcggcttcccaaagtgctagcattgcaggtgtgagccaccacgcctggccataaagccactcttatgtcttggttttatactcaccggtagggagattttggaattttttaactgaagagtgacataatctaaactgggaggactcggggaggcatccactgaagtgtttacaccatgcacatttgcaggtagagacatggaaggaaatcccatgtcttacctcatgcaaaaaatagctacctggaaaagtggacatatcttgccaccaacaccctaccaccagtaccattgcatacatgtcatacatttatcatatgagagtggatataaagtcatattagggccttgtttagtttcattttctttggctgctttcaattgtttcaagactgattgtgttccctgattatctacaaaaccaatcaagtagtaattattaaatagtaacatggaaattaaccaaattatcctgccatctcatccacaccatatagatgccattttgacctgaaaaagctggtatcttagccttaaatgaaaaatgtttgatatgtattaaaacatttgttcgtagatagtgctgccaaggatgttattgtatctgtgagtaaaactaaatccagaacattctcttttaaactttgtttatgagaaagcgacaatgtgatataggtgacagcaagactcacactagcaatgaatggccagtctggtctataggcagctttggaaaactacaaacaggcagatgcagcctgcctcatgacctctttatctagtgtgctaaaagtgcagacctcactttaataatgtgacagatatacccacagttcataaatattaaatacatagcacactttggctgcagagctaaatagatctagctctcatacatgttgataaatgctgcttaacaacgccttagctgactccttggcacctgaggtgtaaaatggttttttagaagaacatatagttggcagggcgcggtggctcatgcctgtaatcccagcactttgggaagccgaggcgggtgtatcacaaagtcaggagatcgagaccatcctggctaacacggtgaaaccccgtctctactaaaaatacaaaaaattagctgagcgtggtggtgggcgcctgtagtcccagctactctggaggctgaggcaggagaatggtgtgaacccgggaggcagagcttgcagtgagctgagatcgtgccactgcactccagcctgggtgacagagcaagactctgtctcaaaaaaaaaaaaagaaagaaatactttggtgtaactctaacaaaatatgtacaagaactgtatgaggaaagctacaaaactctgatgaaagaaatcaaagaaccaaataaacagaaaaatattccatgttcatggataagaagactcaatattattcagatgtcacttcttcataagttgatcaacagattcaatgcaatgtcaatcaaaatcccagcaagttactttgtggatatcaacaaactgactagaaagtttatagagaaagtttataaagaacatatagtttaaaagtctgacctcagggaaaaaacagctaggtaggaatctgccaaccaaggtagcctgtacggtggctaattggaaggacatgttttttcaagttcactcgacccttccatcacttcttagataaaagaactttagaattttaaaagttttggaaatttagtctgccccgatccctgaacactgggtcatcataagcatataaagtggaaagttctcaatttcactgaacattaataattatatatatttttgatgctatttatactatttgagtgtacattgttttgaaagtactgacattgagaaaactcaatctgttattttacaaagtcaaactacctttgtattgttcatataaagatgattttaattcaactcaataaatattaccttgagctcctaccatgcacaagatctgggactgagcatgtcaaggagaataagacatacacaactcattccttatgcttaagagttcacagcctagtgagaaagacgaatgtataagctaaaagtcaccagctggcagcccacaggctaaaatcatccaagagatgtattttatttgatatctgcagtgtttttaaaaaacatttgagttcattgctattagtcagagctttcacctttcagtacaacagaatcgctttgtcatcaactggatataatcacttattgcacccaatggacccttcaaggcatttgagtttggtaccatgaaattgtagacacacaaatattgccactatgattgacttctgcctgtattataatacctaaaattatatggaagaacagagaagagaatagcaagtaagttctctccagctatgtcaagcacgttttgacatgggagatgatacctgccaaaaccagaagggacttccagacagaggaaagatcatgaaggcatggagacatgaaatggtctccatgaaggagaaggaggaaaatatttatccccatgtattgaacatttattgccaaccgctaataggcagtcctcatgtgattcatgataaaccaatatgtttattattagctccacttttcaaatgagaaaactgaatgaaagagaagataaataacttatccaagattaatcagttagtgaatggtagagtcagaattcaaagttctgcctgacctcaaacctagacatttttattactaaacatgatggacgtattagcagattgtagatttattcaggacactttttcagtaattaagagtccaagttccactgaatataagcagaggcaaaaccactggtcccagcctccacttagggaaaatacatgcttcattcagtgtagcgaatggaataaaaattatgtaaatagacttttagagcttaaaggaaacttaggaaagttacagtccacgttcagcattttgcaggtgagaaaattcaggcatttaaaatatttgcttttaaaaagtcgaagaacttctattttaaatacaaattaaaacctacctttcaatatgtcttagtcttaatcaactccaaaatattttaattctccttgctagtgctatagttttaaaatataatttacagcaaccataattttgtgatacgcgttctacaagtccaaagttttaaaaataactcagggaaaaaatgaacatttatttgtaaaagcactaaagaaatacctcataaaaatctagccatgaaactgcactttttgcttcaatacatttattgtgtcctatttaacaaggggatgaaatatctataggattcatattacagttacctgaaggatttttttaagttaaaaataaaacagtaatggtcatattatttttaattgtatttagtgctgaacactgtgggttggggttagtgtgcaggtaaagaggaaaatactaatttagttgtaggggcatgtcaagttacaagaatttagataatggacaaagttatgtgattgcatctttggattagtttagtcagactcagtccctgaaaataatattgtcatatcaaaaattatttgattttctatttttgtattaaaaatgtatgtcataggttaaaaaatagatgtggcaataaatatttatggaataaattaagtcagtgaatggataaaagcataaattagtaagttattcatgaatagttatattttcccattctaagccaaattgaaaattagctcccttccagctatagaaagttgctcttggcctaggaagcaattgagcaggcagagtacttccttagatcctagcaaaatatttgcttaagtaatttgtcacttttcatttgatcatttttgtatccactcactcaacttgcatttattgaaacccagatctgtgcatcttctggtcacattagaggagaccacagcgaactcccagccatcccacctcatgcatcacaatgaggcagtaataatcctttctttaccaaagtaggcagagcagcgtagtctgcccaagactgcatgttttcagttaaggatacgcgaaataaagatctccatggagtaaaagatgcatttttccaatgctttacattaaatgtttcttattgtcattggtcttcctcactggtgacataaacttattgaatctctagcctcatccaccatcacagaaaacaaagaagtatttgctcaaacaaaagaggtttatggtcttacttctgttagtgaaggaaataatgtataatgttataaattactataactaaaaaaaaaagagagaggcatgtaggaaacaaaatatgagttacacaaggaatggagggaaatacacagtctgacaaagtaaggataaatgaaattagataggagacagaagatagaaagatggtaggtaggtcagtacttagatagatggatggatagatgatggatggatggatggatggatagacagacagacagacagacagacagataaggtttgaagtttcaggaatgagccttcttcagggaaagtagcccttggcattgcattaggttcaatagactagtttatctttgcgctttgaagttattcttactgtagctcagaggtaccagagttcatccaaaaccagtaagggaatggctactatgtgccagttacagaactcaatactggatactcaagtataaagaaagggcagggtgtggtggcacatgcctgcaatcccagcactttggaaagccgaggtgggcggatcacctgaggtcaggagttggagaccagcctggccaacatagtaaaaccctgtctctactaaaaatacaaaaattagccggacatggcggcgggcacctgtaatcccagctactcgggaggctgaggcaggagaatcgcttgaacccgggaggcagaatggcagaatccagtgagccaagatcaccccttagcctgggcaacagaatgagactccgtctcaaaaaaaaaaaaagaaactatcttacttctgaatgcagacactctattctcagctcttcaaattattgttcatgttcctatcattaaatattttgggcccaaactctccactgtataaatactcatttgtaaatcatatatatgttctgccttacttattattgttttatgcttattataaaacatacaaaatataaaataaggacaaaataaaaatatttcaaaataatattcactttacatattattggtacaaaatttaacaatttaggtctgactggaagttcattttatttcaatatttgatttcacgtaataatcacactacaaacaggcacaacatacataaaatgctacatatttatggccaggtttgctatgatatgggtggaatctgtactttcaatagtgctcctggtggttttttgtggcctcctctttttagataccatccttattttcataatgtggttggtgaataacacattttaggagttgaagaaattgattttccatattctatttgcttacttgggcctttattatgaattttctaatgaatatccaaggttggacaccactatgtaagaaacaacatggtcttctaggatcactgtgttgggccaggtaaaattaaagctttgccctgattgttcaagcccttgaagtaaattatttacttcattcttactttggcatttttctcactgttttattacttagataagtgatcaccaaaattctctgatcacacacatctaacaataaaaatgtttgagcaagttttacaggggatattatcagtatattttatttataatttatttgtatcaactagtatgatattgtatatatttataaaaaaataaacatagcaattactaaaggatgaggaaaagcataaatataaatggaattttcagtattttctttctaccgcccatcttccatgcactctgttggtatacccccctgcccaattttggaaaacactagtatgaagtaaacttattactgaacaaggtgtaacagaagaggaccaaacacagtaacaagtaatcttcctgcaccacgtcaaacacatatgtgtgcatgtatttcaaatttccaattctaaattttctgtcttttattaagtcagtgtatctattgtctacttatagatcttaatgtgtatttgcaaaaatgcaacctaatgaaaacaatttgaagaagtcatatctcatttatattacagagatattatccttactattaaactttttgccatcaaaagtaaattattaacatgtcatcttcaaagaagggaatcttttctatgaggagtttgtatatgtatgtgggggaatctgcattaggaaattttatcaatttatttcaattttatgcttaaaggcttatttttaaagaaacactaagactgctaaataatagcaatggtttatatttataatcatttgctacatttaattctcatgaacagcccactagagtcagttataattttcaatttacagatgatgaaattgaagcacagtttaagctcattgttagtctgttatcttttacacaaatgttttttgacaatttgccttcagagctgatttgttaagcacatgtgaaaatttctttccttttttataatttcaacttttattttagattaaggaatacatgtgcgggtttgttacatatgcaaatgtttaatgatccttaatttacaacatagagatatttaagggagattgctacaatatcaaatttaaaaagatattttgtttcccagagtttaagtcaagcttgtccaacctgtggcctgggagcctcatgtggcccaggatggctttgaatgtgacccaacacaagttcctaaagtttcttaaaatattatgaggttgtattgcgattttttcttttcttctcttttttttttttagctcatgatctctcgttagtgttagtgtattttatgtgtggcccaagacaattcttcttctaatgtgccccatagtagccaaaagattggacaccccttgttacggattaaatatatattttttaggatgatttgaaaactgattatgctgtaggggccagtttactgtaatcagaatgcttcctcagttgatcaagccagaaggaagcatgcaggccatgtcagcttctgcttttttcccactgtctcgttacatgacctattaactagcaactttttaagataataataataataattctttactaacgtacagtatttctcagtgggtactactagcattttgagaaataattttttttcagagattatacaacttatttcaacaactttagtcttccactcactaaatactaggaatgcctttcctcagtcctaatttgcgactctccctactgggaaagttatcatgaaagtggagaaccactgcactaaggagagaatcgaaatcagagttttagaatattgtatgtgaaatgacacattttgtatcttgaacttgtaacggctagaggaatactcttattacatataaaatctaatttatattaacaaatactccacggaatgtaactaaaaacaaaatattcgtggaagcagatattgctcctgctacacattttagatttcatttactttttagctacaatatcattgaataataaattccacaattaattgaaagaaaacagacagacagagttagcaacttaagcaattgggaaagccagactaaaactaatttatatcaaaccccaaaacttaacacctagtggatgaagaaacaaggaaattataacaaagaattgctgtttctcctgaataaattgtgaaagcttactttagtgtttcatgcaatctctgttgatataactgaccttaaggagaaaaatgataaggcattactatcacgtaatatctcacctgaatatatattcatgtacaccagtccttctattttgtttgtctgttttttcagctgtgaaaaatgacagttccttaaggaagagatgccacaatagatgaaagacctttttacccatggtaaagaaacatagcagagacattatgaatgatgcaggaagcttaggaaaatgaaagctgctattaactatgacaggctgtcacaacaacaaaaacagtaatcaatgcaatcatagcaataagataatatttgtattagtttctttcaaaaagttaaaataatgggtatcttttatgagttgacagtttggataatgttggcaaaaacaggaaaaactcagataaaaatctcaatgtgtaacatattaacattatctagagtcactactttacatatttttgtttttcttcaaattgcctttaatttcatttatatcattttttctttgctcttcatgactatgttattatgtttctttatgatctaatattcttgaactgagtttcctattacttggcttcaataaatccataatcagctaaaattgcattattttagcttttcacagcatataataaaatctgcatttgttgtcattattttccctattgtaacaatatcattactcttgcaactttaagtaagactgctgtataaatatatgatcaccccacttggtattcaatgatgcaccttcattacaagtgttatctcagaaaatgatgaaacattgcaatgtggaaaatgccttgtgtgggaaacattgcacacagacacatattaactttgtgttcaatgatagatattccatgcattcacaaggaagtttgttgcactactccttgtaagttacctcggagtactttctgacttaccacttggcattcttgccctgtctcttaatgtttaagggactccagctcttcatgacagaaccctacactaaggccccataaaatcaacaacaaaactagtttattcactgtatttaattttttttctaagctttctttaatccagtgcacactgtattggcctcacctgttaaaatacacattgtaactttgctctttcatgaaaacatttctaaagatctgagagatgtgaacttttctttaccaataacgttctccatggaaacaagatatatatagtgtgcccagttcctttaattctgacccaagttcaaagaagcctcaaattttaacttatttttggtggagaatttgtgtcaagatacaaagtgaggtctcttcgcaaacacagaacttgctaaatctgagcatgaaaggaaagaccccaggattcaaaatgtgaagctatgcagcctgaggcatttcagagtggctgaacgaaatacagtccttacaatcatcagtgtaacttgttttgttttgttttgttggtgggtgggggagggttctagtgcaatttttgcctttgattggccgtatcagttaccagtgatgcccattcactaatactgcaagtgtattaaattttcatctgagtgagtttaggatcttaaagttattaagacaccaaattatgatgttactattccaaagtgcagagtttctaactcatattcagaggatagcaatctcccaaataagaatgtattcgtgatttatttttattctagtgtgggaagagtttgtcctggtagtctaccaaccacgtggcagtgactcccctccttaggtctcagtttgttggtctaaaatgagtggttttaactagatgatctctacactgttatttcgttctgacactcttttattctatgattcattatataattttatggataaatttccaagccacttactttttctttacaatatccttcttaaaaatgaaaaagcatgtggttttacctttgcaaactctcatgtcttgtccctaatggaaaagtataacaaattaataattgtgtacatcaattttcttgtccctgttgcaaaaatatgtaattactgcatgatgtaaaagttttccttattttaagcactaatagagatagacctaaagtaaagtactgctcctgttgttatagcatatatcagatcttatcgtggctattttctgcatgcctgtaactcatgtaggcatgaattctgcaaataaacaacatcaatgactagcatttatatccattttattattccatgcacagctttatgttctaaatgtaggtttggaaattgtatctagcactctgatgcttctaaccctctttaattgtaactagttgagtagctttcttttcaagaaactaagttgattttataaatttatggagtaaaaaatgcattccatccctttaattttataacttcttcgtaaaatttgatgtctttgttgattttaggttttattccatgtaaatgatcaatgcttttccataaagaagactttgattaatgtcaatttttatctcttaaaaggatccttcccggccattggggtggaggcgttttgccccagcttcctgagggcagggtttttaaatagcatccaggccccgcatccagtgccagggggaggatctttgccccccaggattcctgctggtaggtatttcaggtgaagttttctgccaccatatacagcagtaggattgtgctcatagttgataggccccaaatacaaaatgaatattgcttaaatatattgtggaaaagaaatgtaagtgactgcttaaattcagaaaccatatttataatactgaatgctgtcaaaatggcacaaaggaagtgaaaggactctgcgcacctaattcgcatagtgctgcctcctctcctgagaaaatttttacttaagtaagaattagagcttcagatccaaaatatgtaactcaagaataaacaaagatggacttcagacactttgccacttggaattggccagaaaagtgaattaaaaactaagtgttcttggcagaaagagtaatttcatagagttgatagagaattaaagtatcctttcattacagaaaaaaaaatgatttgaagaaaccagaaagtagcaacctgaaagacatattttagaataaaaattaatatgcatttttccctaaaaatgccaatctgaccaaagccatattttattgagagaaacaaaatataggatattgaacatttaaaaatgcaatttcaaatttactaaaacactttgcaggttatccatggcatgattgtaattacaatttgtttcttccctgacatttagtaaaatatccagctgccttccttcattgtacctaaaggatgcaatcttactttacattttatatgtgtcttagcaaaacagaattcaaatattgattcttggagttttgaaatcataattcttgtgatttttattataactaataataatgctaaaaaattattgttatgacatcaatgtattcaggagagctggcccagcctgcaatgtaatgggaacacttcaaaagactgggaaatccaataaaaacaaaaatcccagcaatgtacatttcttgtccttgttagcataattataccaacaaatcttaagactattctacactgatatttttcctttgcttttcaattactcttttctacttaattgaaacatataaatatgctttgaagtcatttagcttcatcactggataatttattgatgtggttagatactttgtggccaagaataccactgaaagagcagaaaccaaaattacacgagttaaaagattgtaaattttcactttattgggtgttatatagccctttttctccttagagaaagaaatgataccaattgtacagaaattttgttgttgatgatgttgttgcaaaggattagaaagaaaaactatataagccaagctctccgagttaactgcaaatataaacatgtagctttcatgtataattaatatcccagtgattggaatttagaagatgagcagattgtgtagagtttaatggcctcacccttaactcttaatgacaaatcttggtcaagtcagatatgtttggcagaaataacattatgaagtttaagactgacttgaattattcaacatcactgttagaaaacaaaaaacctttgtcatttagctactgagaatgacagaaggaagatgattgttctataacacatacagaaacaactttccagagagggatctaaaagaacattctagcactctattcttctaggctttaagccaaatttgcctcaagctttcataggagagaaaactcagttcagttttcatgacttacatacaaatcaggtgtaaaaaaattgcttcttaaaaaatgtatagatctaaacttgtccctgtttccacaaactgaaattaactcaacacacttttcctggcttatatcattttgataagtcatctctgtacattttgtgtgatactttttggtaatgactgctactatttcaaagaatttttttatcctttcttgttcaactatagcttatttcccaagattttttttatattttgtgtaaagaggaatgaagcagtaatcatgagaagtttttattattttatattttttaaaaaaactaaagtatttctttgccatctaatagctgaattaatacccttcagatttcagacatcaatttgagggcagcaagtgttttctcccatggcccatactatgacactttaaacactcagctgaaggttgatgcccactgggcagcagtaaactcactttctgccaattgattatcggtcacagtattttaagggtcacataagacattttctgtatcagtcaagaaatttaaaaacctgttctattgctaatttagttctcaattacttatcataatcaaatttaaaagagatacgtgactatgtcttatatataatagtttgtgcttcacgtcacactgtgctattaaaaagcagtatttctatagtacttacttttacagtaactatcataatcacagattcattgaatcatgagacctagaaagcagacaagcctgaaattagtatttatgcaacagttgtcaactgtttatgtttctcatttctaaaaaggtcatagtaaagggttattattcttagtttcagatggagaaaaacaccaggaagtattagctgaaaattgaatagcaagtttatcaatacgattaacagaatgcatttgtgtagtagtcaccgatacaggaagaaatcacagaaggccaggcgcggtggctcaggcctgtaatcccagcactttgggaggccaaggcaggtagatcacctgaggtcaggagttagagaccagcctggccaacatggtgagtcgccatctctactaaaaatacaaaaaattagctgggcatggtggcgggcacctgtaatctcagctacttgggaggctgaggcagaggaattgctttatcccggtacgtggaagttgcagtgagccgagatggtgccactgcactccagcctgggcaataaaagcgaaacttcatctcaaaaaagaaaaaaaaggaaatcacaggagagaagaggagaggagaggagaggagaggaagcgaaggagaaaagagaggggagaataaacgaaagaagagaatggggaaggagaagagaaattagaaatgacgtaactctaaaattttattttttaaaggaaagtcttcctccactatatttattactgtttaaatcaaattctaccaccttgaaaagaatgtgtccctcttttaaatatgttatcagacatattctctttttttttttttttttttttgagacggagtctctctctgtcgcccaggctggagtgcagtggcacgatctcggctcactgcaagcttcgcctcccgggttcacgccattctcctgcctcagcctcacgagtagctgggactacaggcgcccgccaccgctcccggctaattttttgtatttttagtagaggcggggtttcactgtgttagccaggatggtctcgatctactgacctcatgatccgcccgcctctgcctcccaaagtgctgggattacaggcgtgagccaccgcgcccggccatatcagacatagtctctaaaataataagcttgctctctttgctccatgtagttatttctttaacttaattatgttgtcaaacagtatttgaaagtggtttagaattttttatatgccatagagtattgagtatacatagtcttagactagtggatcacattatgacagatttcacctctactcaaatcctctatatttttggcagtttgatgtttgccatacacaaacgataggagaataataaagcattaaaaataaaattctacattaatagtgatggagtaacatatagaaatttcatgaattcactttctctgtcacttctcagcaataactatctgacatcatatggtatcttaaatctacataaaatgcaaccattacaatgtgtctcaaaaattagaccaacctataagatgtaaaggcatgtttattatctgctaattactcagcaaatcatatcttaagggtgaatgtgttcatatctacaaaattttagcttacttttttgtcccttttctatcagttgtgagacttgataatattttttactaatgaagtaactcatatacatatatatatatatatatatatatannnnnnnnnnnnnnnnnnnnnnnnnnnnnnnnnnnnnnnnnnnnnnnnnngacactctcatatctgttgttgctgtttaattggtttatccggggatgtggatgcatgacaaatatagttgtgtgaaaggagtgttgaatacgtgcggggaatatgatgcgtctatatatcctgttgttgcaatacagcgggggttttaatgatttctgatttacttgagaggtaggtcgatggatatatcggggtatgcgagggcgcgtaattagggggagggcgagttaaattggctatgtagtgcgcgcggggtatttaagctgtattatggcatatacgtacaaaatgtaacacgagagggacggccaggtactagaggtgtagcgctaaatgggggaaggtaaaaaaggaagggagccatatgcagggatgtatatagataaacatatagatgtaggggtaggatagctcgaggagaactttgcgcgtggacgagcgcgattcgcatatgaatgtatggaatgtatatagatatatgaatatatatatatgtgtgtagtgatgccagactggattatagatatatagacatatatacagagagatagttaaatatggaatatatatatatggaatagagtgggtagccaaactcaaatatatcttaaactaacaagtttaagatatcaattataagagaagtctatgaaagagagaactaggaaacaggcagcatgtgggacttggaaatagacaagctgtgagggaataaaatcagtgttgaatatctccctaatatttcctttgtggttaatcgtagaagctctttagttattgaaggaatattcttctgaggtaccctctctgtttgcctgcctgtgctttaagtacaatgctatatgtataatacctcttttgacatttttacctgagcttctctccattctatgacttgtgttaggttcaaaggaaatggcaaagatagcgtgagacttcctgtctgctgctctgaatcaaataacaggagaattatgaacacatgggtattcaaaaactatatttgcgattactgagtatataattaagaataatgtttaatattgtttatttatttatcctttggaaagagatttggatgagccttatactcaaataccaagcattttgacatcctcactgctattctctgagtagccatgttagaaaatggtttaacaacccagatttctataaaccacatatccaataatgtcatttctatagcaaaggacatacagtcctcagccaacattaaaatgtctttacagtacactaacaatgtttatcaatattttcctttccacatttcatgtgaaatcttgtctgggctgaagtcagggaaaatattgtattcactattatacagtcaaaaatatttttattcagaaagtatatggcttagatgttacaaatggaatgtaagtaagccaggaatgataaataaatttgaagctctagaaaatctaggatctggtggatataatattatcaagttttgatgcatatagaggactgtagaaaagtagtaatgcaaatatataagactaggtggcagactttggagaaatgtacactaagctaaggaaaattggcataaactcaatatgccaaggaaagtcaacagtggaaaagtatatgcattttaaatatgatcaaattgcacttcagaaaaatcaaagtagatcattttatttcttcatattttcagacattctttaaaaagttagtacccatttttattttttattttttttattttttatttatttattttttttggagacacctgtttgtttatttttgccactaatcattatacgttatttaaaaacaagagatgattaaatccatctttcaggtcatttagttaagttttttttttattattatactttaagttttagggtacatgtgcacattgtgcaggttaattacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcaatttttctggctgcatagtattccatggtgtatatgtgccacattttcttaatccagtctatcattgttggacatttgggttggttccgagtctttgctattgtgaataatgccgcaataaacatacgtgtgcatgtgtctttatagcagcatgatttatagtcatttgggtatatacccagtaatgggatggctgggtcaaatggtatttctagttctagatccctgaagaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgaccagtgatgatgagcattttttcatgtgttttttggctgcataaatgtcttcttttgagaagtgtctgttcatgtcctttgcccactttttgatggggttgtttgattttttcttgtaaatttgtttgagttcattgtagattctggatattagccctttgtcagacgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaaatccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggcgttatttctgagggctctgttctgttccattgatctatatctctgttttggtaccagtaccatgctgttttggttactgtagccttgtagtatagtttgaagtcagatagtgtgatgcctccagctttgttcttttggcttaggattgacttggtgatgcgggctcctttttggttccatatgaactttaaagtagttttttccaattctgtgaagaaagtcattggtagcttgatggggatggcattgaatctgtaaattaccttgagcagtatggccatgttcatgatattgattcttcctacccatgagcatggaatgttcttccatttgtttgtatcctcttttatttccttgagcagtggtttgtagttctccttgaagaggtccttcacatccctttaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgctttgtttcttggccaaaaataagactcctcattataaaccaggtgaaaactcagccattatttaaccttcctccccaaccctgattttgaaaagccaaggctctactctcttccccaagaaaatggacatgtgatcatgtatgtaagtgtttacatacaattttaggaagtctctggacatcctaaagtttgcacacaaagaacccctggttctaaagaattcaatgttctatatataaagttatgctgaactgacataagtgagcatcatctttatgtaagactagcagtgcattaaaaaaaaaaagctacgtgatgcatttgatatcaagctcttgagcattacaaagagaatttctatttttctccttccagaaagacatgaaaaatcttaaaagagcctttaagtaatctctagatttttttagtagttcttttttacttctctattttcagaatttttaaatagttctagcctttggccttaactaagccttcttattagcataaatgtttcttttatcttaatgtcatttgaataagtttgaatgttaaaaataaatatgatatatatatggctatttaaattctccattgagagcatacctactccctagatatcttcatgttttattattacagattgtgccatttattttggtcttattcaaagaaactatcagcactttcaaaagatgcattcaaaatcattttcttcttacaaagaaaaattctgaaaatctttccatggcttgctaagttagctgagtcttcatgtaaatcagtatttactatttgtgctgattagtatttttttgtaagggaggtttcaccttaattgggaacataataagaaactaggctgctcagctgtctattcctctccagagagccatgttgagccgcacaggatagcatacatgccctcatgggatgctggaccacttaaaaatataactaacatggagacagaccagccctgctgtaaaacatgtgttggctcagccttcattgttttgctttgtaggacaaatcacagtggaagctgccctatgacaccatgttggcttttcatatttatgttcacagaggtcttaacagcgagtgcatttatcaaagcagaactttttaaaaattaaacatttggaagagttgcagaaaagattaagaaataaatagttacttgcctggtgcattgggggtggggggaaggaaagtagtcagtggtttaattatgtcatatgtatgactatttaacaaatatttttgccattataattaaaatcactctgtaaattacctacgtagttagaatacatgaaatatattctgtttggggtttattttatttttaaattttctgataattttcttttgacagtgaatgatacagaaaagccgaaagcaaaatatttgaacatttatttaataataagacatttttcaagccagaagtaaagcgtagcatttgaaataccactggaaaatatgatgctttctaccaaaagcttagagactctcttaaaatattcaggatgtaacactttctctagtgtcttccccagagtttttgcaaaagcatataacattgctgctctttaatgttctcatatatgcctcttacaactgaaatttcaactgctaagccttgtctttttaagccaaatttgagaatattaatataatataaaacaaatttatttttaatggaaccttaagattattaatataaactgatgtttgagaaagcaaaatctgaaggtttttccaatcagtgtccttagtacatatttcctgtttgtatagaacgttttacagctttgtaggcctttaaaatcctggaatttctcaataaaatatcccagggagcaacacagtgcctagttcataatacccttccaggatatttctaggataagacacagagatttggggtaatgctttatgctcctcaaattactagtggagacaagctttactttggggtataaggagatggccaagcattcagactctggaaccagattgcctggctttaagcccctgagctgccaattgctcactgtgtgtccttaggcaagttgcttaaactctcagtgcatcagtaaccttacctgttaaattgagctaataattacacttgccacaagggtcaatatgaggattaaatgagtttaaacatgtaaagctcatagaacagtgcctagcacattgaagaacttataaaaaattattcttacctacctgctgatttagagtagtatctatttttaaattatacaaacagattttaaagaagaaaaccaagaactaaagcagcatataattatttatttgacatgtaatttaatttagttttgaacttcgacattatatagtatttcaagatatgaaaattccttgctgtgtttttttattgcttcctaatagtaattcaactattaattattacataaccacttccttcataattttggggaagcaaaaatcacaaataatttcaaaagatatgcttttaatttgtatatcaccattacttttctaaatgtgaatgtaatacaaaatcaagaaagacattcttaaaaactcatttgttattaaaatttttcaatatggttagtatcttatagtaaaaacaatccaacatgaggcaaatttgtcagtaactttcattgttaacaagacacttttagttaagaagaaaccttttttcctatatgataatttctagcaggaaggaggacatcactgaatattactgaggtcaactgatgcagatggcatgccactgctctctggaaccggcaggaaaatcatgttttgtttctctagcctcacaccttccatttactctaacaaatctagattaagaaatgttactattttcataaatgcagatcacctttcctaatttttgctcagctcttttatcactagagaaagtattttttcagcatttttccaagggtatttggcttaccactaaattttaaaaaggaaatgaaataaattaagggggaaaatggaatcgaatcatcatagtgactatataaactgagggttttcaaatcactctaagattaaaaccgtcaattctagattaaccataaaacatgttacaggcaaaaatctgtaaacagagtgcagaagatacaacatagattgttaatgggaataagaacctacttttagcagatgttattgttaagaaattatatgttatagtatgttatttaaaataggaaaatactcatataaattgttttactctaccctaagagaaaccatcttgttcattgaagcaatttcaaacctgtcaatttcaggcatatatgatttaaatggacctttgagaccatcagagagctcctaaatttactgacactagtcattttactaatgaaccttattagctctgcaaaccacttcttagcttaggattcaacatctagtcagtaaggtagcatataatactcaacatatagccattcatttaattagctgttattgggtgactcaatattcagtatttggttctattctctgttttaaacacattatccttttcatctcaccaccctaaggaggaggctataataatatacctatatataataaaatcaataataagatacaaatgaggaaattaaatatgccaatgagaaatatataatattcaaatgaggaaacagagacagtgagttgaaaagtgagttaaaaaaggttacttgtccaaaggggaaaacatctccaatatcaggctatgtgactctaatcttacaacttcaactgtactgtgctgggtgagcaaaatatagagtaaccaatcatcctagtttgcctgggacacaagaattttagtgctaaaactggaagtttactgcatcatatgaaacatctaactagcaataattttactttcacttagccaaagatgaaaaaataattttcatgtcaataccaatctgcaataaaaaataaaaattttctatttttttaaaactttttgtgacatagtgtgcaaacataataatacagaagcagatacctatgcacaaaaggaaaggaaagtagatggacatcaacattttagtgacaaacattgtgctaattatatattttctcatccgattatttcaaaaagtttatgtagaacatgatattattctcattttatagatgcaaaaactgaaagagctaaaataacttccctaagatcatgcaactactagttagaggagctgaaatttgaatttttctgtcttcaaaacaatagttttgataatataactaatttaggattaaaaattattgatttgccattctgttatttcagtaaatcttttgtaggtctgcaattgttcttggagaacattcttatgtgtgtgtttcttctgacattcaactcaaaaaatatgaaattgaatacctactctgtgcctagctctgtgcttagatagtgaccttatagagaagaattgggcatttagtcctgaggtcaaagccactttagaatgggagacagacacctatgttgttaacattaatactgtaccgtaagtgttctaaaattgattgagatataaagggaggagaaagtaaactgtcaagacttcctaaaacagagaaattcataggagagtttacaatggagatgatatttaagctgctttttttttaaagtatatgatttttgtcaagtagagataacaagaaggcagtcttccaaagaagagaggaaggtgcaagtaaagtaatattcaggaaattatgagtcactgagagaaattgtaaaggagccataaactctttgccaaggctaaagtcaagaagggtatttcctaggttttcttctaggatttttatagtttgagttcttacatttaaatctttaatccaccttaggttaatttttgtgtatggtgaaaagtaggagtccagtttcattcttctacatatggctagccagttatcccagcaccatttgttgactaggaagtcctttcactattgcttgtttttgtcaattttgttggagatcagatggttagggtgtgtggctgtttctggattctctattcttttccattggtctatgtgcctgtttttgtaccagtaccctgctgttttggttactgttgctttatagtatagtttgaagttgggtaatgatatacctccagctttgttctctttgcttacaattgccttggctatctgggttctttatggttccatatgaattttagaatagtttaattctgtgaaaaatgaggttggtaatttgatgggaataacattgaatctgtaccttgctttgggcagtatggccatttaaatgatatcagtccttccaatttgtgagcttggaatgtttttccatttattcatttcatttctgatttatttcagcagtgttttgtagttctctttgtaaacatctttcacttccttgattagttgaaaaacaggagatatgggaatagggtgaagtaaaagataaaactagaaattaaggtaaagaagagattgtaaatgaacttaattaccaagcaatttagacgttaattctgcaataaacaatgcagtctcaaaatagcggaatgaggcattagcgctttatactaattgactgtttaattatttctagtgcccttcctactatacaccccatgagagcagagatcttgtattgattgacgatatgtctccagaactcagaagagtacttgctacctagtaggcattttaagaaaattttttgtatcactgaatgttcaaaaataatgatttttcaagagttagcttacaatgggaaaccagataggagcaaagaaaccagtaaaatattactgagcaagagaaagcaaaggcagaatatgggcagtggcaacagattttatgtagaatcaatagaacttcataacttatgaactagaaagggtttaataaagtgaggagtccaatgtcacaaaagggtttcaaacctggataactagatggatggtgatgttttaacaacacaggattataacaggaaaagaaagttcaaaggaaatgttaaaagtttggatttgaactgaatgaggatgagatgtgttttgaacgtgatctgataatcatcaggcaacaccataagaagaaaacagttctttaatttgagtacttatgtgaataaaaacaatgatttaatatagtataactgtgttcaaatggcatcatccatatcttctgagtgccttagaggcataagaatatttcatttattatcaaaccaatttgagattataattgtaattcactatctctacaacagaaacatggaaggtagaaatagattaaataactggtccaaagagtcctgagttgcaactgggggaaaaaaatacaggcactctaactgtattttttacagtgataatctaagttatcaccacacattttattgcctggtagacaaaatataaacttgatagtatgttaaataactgaatgacttaaatctgtaatagagttttgaggttgttgagatttgttttgattcttcattttactgactgcacattagaaattgccaaactaatagagaatactacatccagtacaaactcatttcattacatgaaaatgttaagtctctgttatcctctttttttcacaaatattgtctgaggcaaaaaaaaaaaaaaaacacaaaaagatttcactggcaaaatactttaaccagggtatctatggaacatttaaagaattattttgttttctttaacaacagcatgagaaaagtgtagtcttatgattatatagtttatccacatcacctttatcaaaatcatcataagtattagggaacatttgaaaaatatatattggtcaatattcccttaaagtcttaatgtaagaaaataatttttcttttctataacagaaaaggatgataaggggtttttgcaatccatcgtctccagaatatcagtaactgatttcttagaggatcttcattcaaatgcagtttaaaatattcataagcatttctgggatatttatgaaggaaaacctaagaaattcaccttgtgtgacttgtagaagtatctttgaaagtctcttaaatcaaatacatgagacttgaaaatgatctggggatttcaagaattgactaattcaagaagcctggtttgtccactgactttagtatgatgcaaatactaagatgattctgtgatatgaggcagaaggggtgactggctaaaattgtacaaaaagaaataaggtgtaacattttgaaaatttagaaagagataataaattacttcccaatatatcttccaagagcaataatgcaatatgtaatttttacgtactggaaaagaccaaaaaacactgttgccaatagacttctctcacctaaaacagatttaaagattaacatcctaattttcatagtttcccctgtacttatctattttcttgattataaaatgtaatcatggattgtaaagttgcttataatcttcacagtatgactagtttcttctctgttgaaaaccaagacaaattacaggctagatggagcaatagtaaaaaaaaaaaaaattccttagttcaattaacagctgttctcagttgatgctactgcacaaaatacaaaagattaagagttcaaatgtgaaacttctaattcacaggaaaccagggaagccttcatttgattttttattattcttaatgagaagatagaacttgttactgatgaattttaagattacctaaagtatctcccaaagagttataggtagaactaatttcgaagtactgtatattcacatagatcagatcttgttgaaatactccagagtgagtttcttaggaactatgaaatcaagaaaagttaacttgtttttatgaagcacctactatgattagctctatggcaagtgaccttgagaaacccagtgaatgaggatacaaagcattatgggaaaataagaaagaaaaacaacttaatataaaaacaggcacaacatttcatagtgtacacaacagatgtgatggaaatgcaactatgagaaatatcactgtgagagacttttagggaagaggtgtgttgtataaattctaagggagtggggagagacggtaagattagagagagaagcaaattgggagattatcctggcaggtgactacaaaagtaaaggaagaaggagacaggattaaataaatacaagtactaataacaactggtaaagccgtggatacaaaggctagttaggaaagatgaggtgcatcactggaaagaattgactaacagggtgagacttggagcttttatctataaatgctgtctgaaaggcacctatagcataaaggttaagatctcaaactctgagacagactacttgatactgccacttaccagctatttgactttagacaagcagtttaattttctatccctcaatttccacatctgcataagaaaaataattatggcatgtagcaatacaagtggaatgcttgcaagctctttttattctagtaagactggtattcttaagggaaggataaatgtttgttaaagaaaataaaaactaaaagtattcctctgacagcaacagtcaagacagattaaaaagctgtgactctgcaggcaggggaagaagacatcaggcagtcattgtaataacccaacttttcccattaacattcagaatccatcatcattcaaaatggaatattggtctcagaatttttatatttaagtacaaaaacgaccttttattttccccaccttgctacctcagtgtttctatcagtctcctacctccaacctctctgaaactatagccaaataaaagatttcatgattaactttaaggtttaaaacctgaattttctagatccctgcccacaagagtgctgacagttcagttgacctcaataattgacgataaagttctttattcatatttgggtaaaattaatgactttgaggaacattatagaatataagttaatattcactacaaatggaaaacttccttgggttctaattttatgcatgataaattgggagctttattaatacatttaacctttagcacatctttatttaaaatatagattcaaatgtaaagtctagcatttacatacattgtactaattcgtaatagtcaccatcaccctttctaacccacaaggctttgagttcataaaaggaacatgaattacaatatgtaatatttccatcattggtacacatcagttctttctagatctcctttgtgtttgtaaggaaaaactgtgcatagtgcagattgaaaagttaaaaattccaacaagaagtgagaaatacagaagtaaaaactaaatatgtcatacatgcttatttcaggtgaataccatttcccctgcatctgaaatgagtttatcttttaaacttgggcaattgggcagaacaaatgcattcacttctttgaaataaagcagttatttatgtcgaatattctacctaatagaggtgtattgggaactataacagtgtaccaattgatatgataaaaaaggaaagaaaatatgttcagtttctgatcttatcttctataccagactacaaaatcagagttacttatttttcatgtactgccatcattgctctgttgattaaatctatgtccaatgaagacataatcaggaactattacaaatcctacaagctctgtagcattcatcaatctaaaatttttctgcttaaaggcccttaaaatcagactatgaccgatggtttataatttctttgagagaatttatgagtttctcctttctgctttgccttaggaatatttcagaaatgcccactgtaatataagtcaggcaaaattgctgcactgccttagaagttgtaccacaactgcaaaagcagctataataactgcttaaatcctgacttcagcttgttgattgttttctaaggaaaaactagaggacaaaaagaacataatctaaacaagtgattgcagggctttaggaaaagaagtacctaattcctttgtaatttatattgtaattcatgtcccttttatgaactcaaaaggaaataatgctataaagaaatatagaggtgcctatgtataatatgaatacgtttatagaagcaggctggaaaatgaaattcctattaataaaatacaaataatttagttgccacagctgggtatctcttaactgcagcacatatttctgtaattgctctaatccatgtgtattctcttgctcttttgcaggcagaccagtaatgattgtggtggaatatatggagaatggatccctagactcctttttgcgggtgaggtgttcttttctgatggcatttaaataagctattctcagttctatatttaaatcatttatcataaattaatttttgcataatgttattcatggattttctgtgaagaatagcagtgttttctctagggtgcatttccctgatactgtgatacattagagtgttactaaggggggaggatgtacactcaataacgtaattgatttctcctctaaattcacttgctatatgtgtgtgtatatatatgtgtgtgtgtgtataccaaataatgttatcatgaagaaagattaaatgaaactcaattgcctcacagtcattaattttgctttatcacatttaactatgtagtatgatattgtatgcattatctataatgctgaactccttaactgatctgtatttaccaacaatgactcaagttcatttcagaaaatgttctatcaactttgtccttcttcagttcatttggctgactattcagaaaacaaagggaggaggaataaaactcctttagcagagatttcttttacaaaaacattatttttaaagtgatttatctttaaaagtatagtatatacgaaaagtaatttattatagatagtgatacaaacataaactgagaaggcaccaggaagttagatttcaaggtatatttataatacatttaagatttgaaaaagcatcatgtgctatgaaaatattcattgatagtgaaaaaagtgaaatataaaaaataaatgctatagtaaatatttttcatccccagcaaaggtcatatatttgcatgtcactgtatttttaatatctatctatctgtctatctgtctatctatctatatatatataactatttttctcacttacaaaatggctggactttgccacttgggatgttacattatttttcttctttattttcatgtgaaaataaagcattcacttcacttcgttttttgccccatgttatgtgaataagttctgtttgcatctcatctttctctcttgatctcattttcatttatttttcttggttctgggccctcttcttccaactgctctgaatgctagcagtgatgatatatttatactctgactgggcttgatgtccagattcaatcctagaagctgaattcagcaaaatcatcaagttattatagagcaatgctgctcgtgcagtgtatactctcaaccaagtgtgctctgtaaggtaaaatgaaattcagaggtgtttggggacatgaactgtttgttcttttctgtagccattctaaaaatgtgttattttatagcttgtgttcatttaacctgttctaaattattttagaataatttacaggaccacctatggtacttgaaatgctgtgtacttagtacttgaaatgctgtatacttaatgtccttccattatgtttcttcaaaaactcattcttatcagatacatatcaaaatgactcatcatctaatgatgcttgggttaggttggttttctttttattttcttctttttatttttgtatcagctgtatcctaaagcagaatataatggcaaacagtgtagcagatattcaatctaaattgctgctaaaaatggatcaaatgactaccacaagcaaataaggtgggaaatattagcttctcccctaatttatatattttattctgtggaataatgaatccattaaatgttttaaagaaacaataatatgttacaaataaaagatttacttctaaacatcttactacatgtttagaagtagtgtattttatgctttaaattttaaaaactaatatttttcagctcttattatgtactgtgtatgtaagacattatcagagattctgaatacctatctcagctaattttggctctactcatggactatgtgaccttgggcatggtatcaaattctctgtacctctgtttactcatctataaaattctctgtacctctgtttactcatccacctcatacaattattataaagattgattgttgtaaagcttgcagaatagtgcttgacatattgcaggtggcagagcaaggattcaaactcaagtctctatgactcaaaaagccatgctctcatgcgttatgaattcattttattaaattgcttactacttttccttataagtccactaccatctcctcatggtgtgtgtcccctttgcacgtagagtttctaaaagtcacattattataatgcaaaaaaaaaatcaaatgaatggaaaaatagggtcaatacttccatcttactcttctttaatgttcttacccttctttgtaatcatctctcttcttagaagctcaaagtgctttataaactttgtgttaatagcagatactcaactccccatgacaagcggaaataaaatatataaatatatatagcccatacattctcaaaagcaaagtcatttttcaaactacagctttagaacataatcacagcttatgtgagcacaggaaggaggaagtggctaagtgcactgtgtagtaggggagccatccgtggctcataatagccttctgtgcttactggaagcagaaatgatttccctttggtctcccacactatttgaaaactgcttcaatttgttattttattatgaaggagtggtagcactactaagtacaagattacatctagtgtcagtgctggttgctggctggctgtcatattgcactggattcatcaatctcataccatttgggatccttggggacattcttccagatatatatcggcagaggggcagtgtagtcaagtgtgtgtgtgggcttgtgtgtgaaaatatacatgtgtgtagagaagggatgtgtgtgtaaccgtgtgtatttttaattttaaagttgaatacattctgacttagcaagcaaatcatcagcagcctggctgcccagaaggcacaacttcaccaatgtgcagaatttttaacttttctaagcccatttggggatagtggtcaaggttacacttaattcacactaatgtattttctctaatttcactaaaattcactagtgcgaattaaatgtaaccttgaccattatccccatacaggctttttccagctacacatttggatttcataaatactttttgtggcacttacctgcaaaccacctacctctaaattttagaaattcccatttcagaacattccacttagaacttcccattttttataacaatattaactagaatctaaactaagtatagctatagaatactttaacattgttttttgttttttgtttttattatactttaagttttagggtacatgtgcttatagaatactttaactttgaaatgccacatgtcaaccacaaaaaaattcctttgttttataacatttgttgaatgttaatttatcatattgcaaaattcagttataccaaaatataatactaaatttactactggtttcagtgcaagatggtgtgttcatgagagaaaaggtatacttactttttttttttttttttttgagacagagtcttgctctgtcaccaggctggagtgtagtggcacgatcttggctcactgcaacctccgcctcccgggttcaagtgattctcctgcctcagcctcccaagtaactggaactacaggtgtgcaccaccacacccagctaattttttttttttttttttttttttttgtattttagaagagacggggtttcaccacattggccaggatgatttcaatttccttatctcatgatccgcctgccttggccttccaaagtgctgggattacaggcgtgagccactgtccctggcctatacttacattttttacagtgcaaatcacttaggcaaataagaaagggggtcatctataaaccaaaaatctaggagaaattaataaagaaagcaagaaggatttaattaagtaaggaaatcagctcaaaatatgctcagggaaagatggctgggagcaagaaaagtgagtggaaggtggtgctatcaattgaaataaagatacagaggaggaacaggatggactggtagttggaaagaaatggtaagtttaattttggtcatgttgcatttgagatgtctgtgaaacatccactgaaaatgttcagtgggtggggaccaagatggctgactagaagcagctatggtgtgtggctcttacagagaggaatgaaagaggtgaataatacagaaccttcaactgaaacatccagtacttgcactgggactgatcagggaaacagtttgacctacagagaatggagaaaagaaggtcaatgacccacccaggagcaacacagagcaacgggaacctcccctaccctgggaagcagttagtgaatgtgtgacccccggaaaccacacttctcccatggatttttgcaactcttgggtcaggagatgcccttgcgaacccactccaccagggttttcagtctgacacacagaactgtgtgaagtcctggcagagaagctttgcagattcacagagtcctgggagctttatatacgtgggctctggggtccccggcaaatgtgacagtgactcaggcaaggtgaaaagttggacctccatacatagccctgaaaagggagctgaatccagggggcagagcagcatcggtctgcaggccccacctccacagtagcctacgggataagacctactggcttgaaattccagccagcccctggtgacattgttgtacctacctgggacaggatagagttcctggggggaggggcaggcctccatctttattgtttggacaacttagccatttcagtctctgggctttggagagtccaaattgaccagggatagaagggatcccccaacacagcacatctgctctaccaaaacatgtccagattgcctctttaaccaatgtattcctcctcactggtggggcatcccaactgggccctccagccaccccctcctgtgttctccagcccaacagagatttgaattctccctggtatggagagcccagaaaggggtgggctgccatctttgctgtcctgcaacttagtggttacagcttccgggctttggagagcccaagctgaccaggagcagaagcagtaccccagcaggacacagctactctacaaaaaagtgactagactgcttcttgaagagtgtatctaatcctaatcctcctgactgggtgagatctcccaagcagggtctccagccgccttctacaagtgtgttggaactggcaacaggatccatacctcctgggacagagctcacagaggaagggccatcttttgcggtttcagagccttcactggtgatacctttcaggtactggaaaatccaaggcaaccaggcactggagcagacccccagaaaattatagcagccctatagaaaagtggccggaccattaaaaggaaaaaaataaataaatccaaaggtcagcaacctcaaagattgaaaatggagaagcccacaatgatgagaaagaatcagtgcaagaacactgaaaactcaaaaagccagagtgtcctctttcctccaaatgaccacattacctctccagcaagggttcagaactggactgaggctgagatggctgagacgacagaagtaggcttccaaatgtgtctaagaaaatcttcactgagctaaagggacatgttctaactcaacacaaggaagctaaaaatcatgataaaacattgcaggagctgacagtcaaaatagccagtatagagaacataactgaactgattgacagagctaaaaaacacaataaaagaatttcataatgtaatcacaagtattaatagcagaatagaccaaatagagggaagaatctcagaacttaaagtttgggtttctgaaataacactggtagacaagaatagagaaaaaaaatgaaaatgaataaacaaaacctccaagaaatataggattatgtaaaaagatcaaatctacaactgattggtgtacctgaaagagatggggagaatggaaccaatgtagaaaacatatttcagaatatcatccatgagaacttacccaaccaagctagacaggccaacattcaaattcaggaaatgcagagaaccccagtaaaatactcaatgagaagattatcctcaggacacataatcatcagattctccaaggtcaaaatacaggaaaaaatgttaatggcagtcagagagaagggccagatcacctacaaaggggagcccatcagactaacagagaaccttttagcagaaaccttataagccacaagacattgggggcattcaacattgttaaaggaaagagattccaacccagaatttcatatccattcaaactaagcttcataagaaaagggaaataaggtccttttcagacaagtaaatgctgagggaattcatcaccaccagacctgtcttataagagctcctgaaggaagcctaaatgcagaaaggaaaaactattaccagccacaacaaaaaacacaatgaagtacacagaacagtgacactataaattaaccacataaacaagtctgcaaaataattagctagcatcacgatgtcaggatcaaatccacacataacaatactaacctgaaatgtaaatgggctaagtgcctcaattaaaagataaaaaaatggcaagctggataaagaactaagacctatcaatatgctgtcttcaagagacccatctcactcacatgcagtaacacaggtaggctcaaaataaagtgatgcaggaaaatttaccaagcaaatggacaacagaaaaaaccagggttgccatcccagtttttgacaaaacagactttaaaccaacaaagatcaaaaaagacaaagaaaggtattacataatggtaaagggttcaattcaacaagatgagctggctatcctaaatatatatgcaccaacacaggagcgctcagattcataaagcaagttatcagagaccttgaaagagacttagactcccacacaataatagtggaagactttaaaaccccactgtgaatattagacagatcatcaagatagaaaattcacaaagatattcaggacctgaactcagctctggattgaatggacttgatagatatctaaagacctctccactccaatgcaacagcatatacatttttctcgtcaccacatggcacttactctaaaattgatcacataattggaagtaaatcactcctcagcaaatgtgaaagaactgatatcataacattctctcagaccacagcacaatcaaattggaactcaagactaagaaatacactcaaaaccacacaattacatggaaattgtataacctgctcctgaatgacttttgggtaaataatgaacttaaggcagaaatcaagaagttccttgaaactaatgagaataaatatacaatgtgccagaatctctgggatacagccaaggcaatgttaagacggaaatatttagcactaaatacccacctcaaaaatctggaaggaactcaagtcatcaacctaacatcaaaactaaaagaatgacagaaccaggagcaaacaaatcccaaagctagcagaggatgagaaataactaagatcagagctgggctacagagaaatgaaaaaccattgaaaagctcaacaaatccaggtgctagtttatttaaaaattgataaaatatctagactgctagctagactaataaagaagaaaagagagaagattcaaataacacaatcagaaatgataagggagatattaccccacagaaatacaagcaacgatcagagaatactataaacacctctattcacataaattagaaaatctagaagaaattgataagttcctggacacatgcaccctcccaagactgaaccaggaagaaattgaatcccttaacacatcaataacaggttctgaaattgaggaaataataaatagctttccaacccaaaaaagcccaggaccagatggattcacagctgaattctaccagatgtactaagaaaagctggtaccattcctactgaaacaatactaaaaaaattgaaaaggaaggactccaccataactcattctatgaggccagcatcttcctgataccaaaacctggcagcaatacaacaaaaaagaaaacttcaggccaatatccttgctaaacatcaatgcaaaaatcctcaacaaaatactggcaaactgaatccagcagcacatcaaagagcttatccaccatgatcaagtagttgtgatcatccccagggtgcaagattggttcaacatatgtaaatcaataaatgtgattcataacataaacagaactaaaaacaaaaaccacatgattgtctcaatagatgcagaaaaggcttttgatgaaattcaactccttcatgttaaaaactctcaataaactaggtattgaaggaatatgcctcaaaataacaagagccatttatgacaaactgacagccaacatcatactgaatgggcaaaagctggaaacattgcccttgaaaaagggcacaagacaaggatgccctatctcaccactcctattcaacatagtatggaaattctatacagagcaatcagacaatagaaaaagggggggggggggcatccaaataggaagagaggaagtcaaacttatccctgtttgtagattacatgatcctatatctacaaaagcccattgtctcagcccaaaatcttcttaagctgataagcaacttcagcaaactctcaggatacaaaatcaatgtggaatcattacgagcattcctatacaccaacaacagtcaggccaatagccaaatcacaaaggaaccaaattcacaattgccacaaaaagaataaaacacctaggaatacatctaacaagggaagtgaaagatctctacaaggaaaactataaaccactactcaaagaaatcagagctgacacaaacaaatggaaaaactttccatgactatggataggaagaatcaatattgttaaagtggccatactgcccaaagcaatttacagattcaaagctatttccataaaactaccattggtgttcttcacagaactagaaaaaactattttaacattcgtatggaaccaacaaagaacccaagtagtcaaggcagtcctaagctaaaagaacaaagctggaggcatcatgctactcaacttcaaactataccataggactacagtgagcaaaatagcatggtactggtacaagaacagacacatagaccagtggaagagaagagagaacacagaaataagactacacacctacagctatctaatccttgacaaacctgacaaaaacaagcaatgaggaaaagatttctttattcaataaagggtactggtataactggctagccatatgcagaaaattgaaactggacccttttcttacaccatatacagaaattaactcaagaaggattaaagagttaagtgtaaaacctaaaaatataaaaaccctggaagacaacctaggtaataccattcaggagataggcacggccaaaaattttatgatgaagacaccaaaataattgcaacaaaagtaaaaatggacaaatagaatctaatcaaactaaagagcttccacatagcaaaagaaactattatcagagtaaatggacaacctacagaatgggagaaaacttctgcaaactatgcatctgacagagttctaatatccagcatatataaggaacttaaacaaatttacaagaaaaaagcaaacaaccccattaaaaactggtcaaaggacatgaacagacatgtaaaaggagacatacatgtggccaagaagtatatgaaaaaactcagtatcactgatcgttagagaaatgcaaatcaaaaccacaatgagttaccatctcacaccagtcagaatggctattattaaaaaatcaaacattaatagatgcaggcaaggtggtggagaaaaagcaatggctatacactgttggtggcagtgtaaattagttcaatcattgtaacagacagtgtggcaattcctcagagacctaaagacagaaataacatttgacccagcaaccccattactgagtatatacccaaaggaatagaaatcgttctattataaacacacacgcatgcatatattcattgcagcactatacaaaattgcaaagatgtggaatcaacccaaatgcccatcaatgatagactggatgaagaaaatatggtacatatacaccatggaatactatgcagtcgtgaaaaataatgagatcacatcctttgcaggcacaaggatggaactagaggctgttatccttagcaaactaacacaggaacagaaaccaagcactgcatgttatcatttataagtgagaactaaatgatgagaacacatggacaacacatagaagggaacaacacacactggggcctctcagagagtggagggtgggaggagggagaggatcaggaaaaataactaatggatgctagacttaatacctgaagggtgaaataatctgtacaacaagcccccatgacacaaccatttaagaaatctgcacatcctgcacatgtacccctgaacttaaaataaaagttttgaatttcttttttaaaaaaggaaatgtccagacagcaatttaaaatacaaatctgatgctcagtggaaaaatcttggctaaagttgaacatctgggtcttggtagcataaaggtagttactaaatgcaaaccaggatatttcctaagaagaaagttgaaccagggtggaactttgtgccataccaatctgaagggccccatggatggaatacccaaaggtaactaggcaagagtgggcaaagaggaacaaggaaggagagaaaaacatgaagtccccagacccaggggaatatagcttttaagtcagaagcatataaccgattgtgacaaattcaggagaggaattctgaaagacagaaacagagaaacatctataggatttagcaaataagagggactcagtgttctcaacaagagcactttcaatggcttggtcccaggcagaagccagattgcagagagcaaaaatgagaatgaacaactaacaggaatttgtaggtggagatgattcctttgggaacaggtggatgagatgtcaaggcaagcaataaatcaaatgctagtatgctagtagaccaaaatataagaaaaatcaaggatttcttttcaatttttttattttgataaaatacacataacataaaatttaccatcttaaccatttttaagtgcacaattcagtggtattaagtacattcatatcattgtgcaaatatcaccagtatccatctgcagaactctatttatctggcaaaactgaaatgctgtactcattaggtaattaaactttcccacttctttaaaatcattaaactccccacttctcccttcccccagcccctggcaaacagcattccgctgtctgtctctatgagtttgactactcttagtatctcatgtaagtgaaatcatatagtatttgtcttttgtgattggcttatttcacttagcataatgtcctcaaagttcagtcatgttgaagtgtatgtcagaatctcctttctttttaaggataaatgatattcccttgtatgtatatgccacattttgcttatccattcatctcctggtggatatttgtattgctttcatgttttagctattgcgaagaatgctactgtgagaatagatgcactttgacaccctactttccattcatttgagtatatatccagaagtgggattactggataatactttaattctatttttaacttttagggaaaccaccatactgttttctatagtggctatgtcattttacattcctaccaacagagtacaagggtttcaatttctctgtattctcactaacacatgttattttctgatgtttttgtttgttttatgtttgttgttataatggctatcctgatggatgtgaagtggtgtctcaacgaagttttaatttctgtaatgatttgtggttttcaggatcttttcagtgcttattggccatttgtatatctactttataaaagtatctattcaagtccattttccatttttgaatcaggttgcttgatttttttttgttgaattttaggagttctctatataggatggatactattcccttaggagatatatgatttacaagcattttctcccattctgtgcgttgcctttctactctgcagatagtgttttttgaggcacaaaagtttttaagtttcatgtggcacagtttgtcagttttttcttttgttgcctgtggctttggtatcatatctaagaaatcattgccaaatctaatgttatgaaggttttgcactgtgttttcttctaagagttttataacttgaggtcttacatttaggtctttgatgcattttgagttaatttttacatatgttttaggtaaagattgaacttcatcattttgcatgttgatattcagctttcctagcatcatttattgaaaagactgtactttccaaatttaataatcttggcacccttttcaaaaattatgtgaccattgtattagtcccttcctgcttgtataacaatataacacagattggataattaataaataatagaaatttatttctcacagttctggaagctgagaagtccaagcccaagggtaatggcttactatccttctaagatggcattttcttgatgcattctatatgacagaagggacaaaagctgtgtgcttacatggtggaagagcagaagagcaaaaagggcaaaaaggagctaggacgctcttttcaccctcttttacaatagcattaatcccattcatgaggattgagtgttcatgagttaatcatttaccaaaagcccaactcttaatactatcacattaagtattagattccagcatatgaatttggaaaggacacatacatccaagccatagcaatcatacatgaaaaggtttatttctgggctctctaatctattccattggtcaatatgtgtgtctttatgcaaataccacaatattttgattattgtagctttatactaagttttgaaatcaggaaatgtgaatcctccagctttgctcttctctgttggttatctaaggtcccttgaaatataacgtgaatgtgaattctagggtggacttctgtgtttctgccaaaaaaaaaagttgttgttggaattctgttagttatgttgaatcgaagttgtgaaagtgccatcctggccctcttcattatcttagaggaaaaactttcaatttataacggtcgagtatgatgttcactgtgggttatataaacatacatatagcttttattatgtcaaagtaattttcttttattcctagcttgttgagtgtttttatcgtgaaactgtgatgagttttgtcaaatgttttcttcttcaccaatttagatcattgtggagatcttcccccttcattcagttaatgtggtgtgttacattgactgactttcatatttgaaccatcctgacattcaaattattaatttgaattaattcaatttggccatgatgtataatacttttaacatgctgctgaattccatctgctagtattttcttggggattttttcataaatggttaagggatattggtctatagtaatgtgggggttttttgtagtgtctttgtctggctttagtatcaaggtaatgttcatggaatgaatcaaaatgtctctctcctcttcaatttttcaggatgaagtttgaggaggatttgtgttcattctttaaatgtttggtagacttcaccaataaagccatcatcatcaggtccaaggattttctttatcaagagattttttattactaatttaatcttattactagttataggtctattcaggttttttatttcttcatcatctagtcttgataggttttgtgttcctaggaatttttccattttatccaggttatctaattgttcacatacaatcatttatagtactgtcataatcctttttatttctgtagaattggtagtaatattacaccttcattctggttttagtaatttcagtcttctcttcattttcttggtcaatctagataaaagtttgttgattttgttgttcttttggaagaaccaacttttggttttgtggattttctttattgtttttctattctctattttatttatctttcttctaatatttatttccttatttttgttacccttggttttagtttgttcttctcttgttccttacgttgttaaggtaggttgtggtttggagatcttcctctttctcaatacagacatttatagccacaaatttcctccttggctctgctttggacgtgtgtcctacaaattgtaatatgaggtactttcattttcagtagtcactaagtattttctaattctctttgtgatttcttctttgatccattggttgtctaagagtttattgtttatacacaaatttgtggatttttccgtttttcttctgttatttacttcttactttatctgttgtagtcagagaacatactttgtatgaaatctactatttgaaatctcttgatacttaaatttattgtctaacatatggcttatcaaagaaaatattccacatgaaattttgttctatttttcttgggtatagtgtgtacttctgttagatctagttggtttattgtgtcattcaagtcctttatattcttatcttctctctggttgttctgtccatttttcagagtgggattttgaaatgtttgtctgtctgtttctcccttcaattctgtcaatttttgtttcatatattttgatggtctgttgttacttatgttaatgtttgtaattgttgtatcttaaaatcaaggatatttttaaaatagatgacaatttggactatgtatacactgaaaaagaagaagggaccatttaaaaacttgataaaacaaaagatttaaggagatgaaaaggtacaaaatcaaggaacctagtggaggattgactttggagagtagaagccgccacatctcccaagactggagtgttgggaatctagatagctttatgaggaacatgcataaattgaaggaaatgatgcctgattctattgcatttctatacaaagtagtagaagagtttttatgggaattttgaggacaaactttcctttaaggtgaatgtttggaataattattgaaattaaaaagaaaagtagcagatcatgaaaatgctggaccatgaagagcaagttctactactgtttttttaaggccccagcaggtgcaaccaaccaaaaatcttcatcaaagttattaattgtatgcaatgtaagtatccaggagagatgatcttttggcctgttggcccagttatatgtgctagttgtatacatttgttccccaaacttgccagccctcatcttggtcctggagaaaaataattaactaataatgctgaacattcagctgatgctgaagaacataaatgtgttatggcagtgatgtgcatgcttatgtgattttctacatgaacactcaactccccaaatgtaagagtgaagataatagaaactatggtttgtagagcatgtacaaaagaaaaacaaggatgccaaaaggggactgaggatggtagtgaagggatcattcaggtaacagaccgtgagtccatgctagataaagaaggaaataaagagcctaatagactagaaagaatcgagagtatatgggctagaagtctttattgcatagatgagaaagtatagttttgtatgagggtaagagaggaagggaaagaagaatgtggccagaaagtagggtactggcagtagtgtgctaaagccagatcataccagtttgcaagagctggttgataaactattagtagcttaaaatttgctatgttgggagtagttacaccacaggaattggcaaatgctacaaatcagggctttctgtcttattttttctctggagagcaggtttaccaccataatactaggttgatgtttaagatttctaaagtgaggcagttttagaaatgacaacttccagatgtccatttgggagtctgtggctgaaataaagatgagattaatatacttaataaactaatgtaactaacatttacatgtgctttctatgggtcagtcattattccagtcccatgcattagctcacttattgtttacaacagcactgtgaagtagttattaccactatcctcattttaccagtgaccaaactgaggcaaggcaagttaggtggcttgcccaatgtcaaacagctgataaatcatttattcatttgttatgcaaatatgtattgacagactacagtaggccaggtacttttctggatcctggaatacagaagtaagcaaaagagaattaaaaaatttagtgggtagagaaaaaagaattcagcaaaatatatggtaagtcagatgttattattgctgtggagaaaaataaagcagggaaaaggcaagtggagttgagagtgggtttcaggattacattgagtggcagagaaggtctcactgaaacatggcatttgagtaaagtattagaagaaggtaagggagcaaataaagtggatacctgagtagaaaatattccagggaatagtaatagcaagtgccagttctctgaagtaggagcattttatttctacagaatggcaaataagtatttatgcttgatgaacataatgcctgtttttcctaaaacaatgccaaattatgcatgttatcccttcacaattattagcatgagccttttactctgcagttagaataataaaatatatagtcaccctatcactatggctagagaagattatgtaagaagaatagtaaaagataaaatcagagcagatggagacagaaagggaaacatctcttggacaacaatgattctcatatttggctatatattataataatttaaatttgaagaccttttaaaaatctcaagttccaggctttaccccagaccaatgaaatcaaaatctcttgggatgggacatatgcatcaatatttgtcaaaagttcccccagttgagtccaatatgcagccaagttggaaaactactgaaatgaggcctagtaggccattataatgactttgactcttctctgagtaatatgggaagccactgtagtctttggaatagaggcatagcatgatgacctaattactatattttataaggatcactctgtttgctgtattaagaagagactacagtgaggcacaaatagatgcagggaaattaggaggcttttgccataatccaggtaagagataatgatgctctaaactaggatcgttgcagtagagtttatgggaaatggtcaaagtctatgatgtatgttaaaagtagagccaataggatttgctgatggattggataaagtgcataaaagaaagagaaaatcaaggacaacattttacgtacaaaataagttcaatgataggcaataactgtttcctaaggttattgcactacagtattaaatggctaatatacataaaactcctagaacagtgtctgccacataatcaggtattcataaggtcatctattattattatattatatttcagaagatatcactaagagtcataaaattgtctgttacttcctgatctgttttttcaggtggctaaaaatagtttcaatttttaccattaaaaaatgtagatatacttcaggaatatgactattgaaataacatatctaagtgcatatcagcatttcaacagcaatgtgagacatttgaagagtttccttgagcaaatgtgaagcaaatattaatttaaaaattaaagagatcttttaaatatttatgtactcaaattataaatctagtaaagatggcatttcaccttatactagttatttattaataatgagagctgtattttattagcacacttttcttgtaaattgtgtgcatgtggttatatttgtgctgaggtagaaaagtgaaattaatctaaataacactcattttatattcagcagtggaaaagaagaaaattgcatttacccaccaataactgtttgtttgtttgtttatttatttatttggagcctttattgcccgggctggagtgtagtggcgtgattatagttcaccgcaacctcaaacttctgggcttgaaattctcccaactcagcctcttgaatagctgggaccacaggcatacaccaccgcgctagctaattttttatttttgtagagatggggtcttactctgttgcccaggcttgtctcaatctcctggcctcaaatgatcctcctgcttcagcctcccaaaatgctgggattagagatgtgagccaccatgcctggccaactgtttttaagccataaaaactatagttgaaacacaccttaattacatttttaagagaaaaataggttaaacttcatgcagtagaatgttatcttttactatacctgtgtcagcttaatgctaaatactattctaaaaataatgtgacatcagacatgcacatatatgagagcatggtgtgcttagaaccaagcatatggtatggatgagtgaacttttttgtaaattaggagtttgagcagcaatattcaatagcatgagtatacctctttaaacactgtattaactgataccatgaaattataatttataattctcattaattcttcttttgcatacaaaacttgacattgatcttttgattgtatataatgtaaaattatatataaagaaattctatgtatttttcctgaactcctctatggtcactcctatccctttgtttgtaccatttatgagatattggatttacagaactgaatattaaaccctaaatttataatttaaccatgctcaataaccagaatcaccatcttagagagacttcaccagatacatatgcagacacacacagatatggtctgcaaaaacttccctggattattctgatatgctctaatgatgcttcatcaagatgatggcactttgtgacaccctaccccaaataataactttaaatttaattttgactttgtataaatatagtacacagtaactagtatatattactttcatataaatctaagcagaagttattttgaacaaagcaaattcagtagtaacctttgtaagctaaagctatattatattcagattcatttttagctcttaacatgtaattctgaaatccaaccaccatgtttcacaaatccatatctacttatgttcttcctaggtttttaggtgtattagaaatgacatttttagttttcttattattgaaattactgatttcactcttggtggcctctctcaactacaactaaaaatataactgtgcctagcttaagttcaaaatgtatgatgactacaagagaaagatctttgaaggatttattaagttaaattataataagattttcaactgggaagaccacaagaactcagacaattttcaataaaaaggagatagttacttatttatttggtggttattttaaaaacaagagtgatttggtgttttgaaatctataaataatcccaaacatttctttttcaaattcaacatcattttaaaaagtcatagtgtagtcacctttttgatttagaaacatataaaaactgaaatttaactttaaacttaagttatagaagtaatcctccaaggactgttttctgcaaagtcatttataaatcaattgttcagaacttaaaatgcatttttccataaatatttcttttaaagacatttctgaagtccctgggcagacttatagaagcctctttaacacagactacagctaaaagatgaaacgtccaataagaaagaggcctggaagtttccttcaaaatggggaaagtgtgttttccttccctttacatgacttgccccgggcaaaaattttaaggcaatttttctatgtatctacctatttcgtcatgtcttccttccaagtcctcaaatataaaacttttattgtgacaaatcacatgtggtagcacttcttcatcccctcttgcctgagtttaggtctttttccaccttataaaaccacctgtgacctggactgtcatcccatcctaatctcagtttccattttctcattggcacaaatcttagctggatataaggttagattgatttatgcgagtatgtgactcacaaatactattctaattcctccagatgatttttcatcttttactgcatttgtaaaccccaaaaatattttaatagaggaatttcagagagcaaaacaaaagtaagtggaaagaggcagataatatgggtgaggatatttttgtaccaaaggacgatcagtaccccaaaagtcagatcctctgtgttgttctggctcttcagagatgcccatcttttgtctcttatgaaccctttgcatttctgacatccagttttttgagaatgacctctagcaacacaaaaatgggaacgagaggcttgaagtgtccagtgtttgcataccttggtcttttgtaaaccatctagtaaggtaaatgtcctgtgtagccattttatagctcaagtcaaaggtttggaattaataattttacaaggcttccacttagccttctttttttgtcattttgttttgaaaggctagtgtcatttcttataattcatagttagtgaaccaaaaaggcttttgatatacatatggaccaaatttccattacttctttttttagcttaaattgtcattatccaatagtatttattgaaccagatttgtgaggaatctgtgaaatttgtttattgtaggtacccatgacaccacattgtgaagggtatcctctaaatgtttgtagaatcagtgacatgcaatttttgttaattctcctcaagaatagcagcttatcatctaccagttatagtgtcatctaccatcatatttaaccttttaaggacactgaatcgccagagttatctgctttaataatgcacatttttcggcaagaaagtttgagggcagtgatttatattatggtccatagatctttgacagtttctgagctattcggttggtgggcttgacatcagtgattctccattgaagatctagaaagaaatatagcagatatctatataagatatttagttcccttttcctcactcttcagcaaaaatataaaaattttgtagtagtcataatcagagtcttgtcctcaaaagtggagacggctgcaagtgtagtcaacacttcagtacttcttggtcattcgtgatctttgcagagaatctcctatagtaaatatgacttttcattaaaaatacatcaagagaatatcttaccgcatactgaaagtttgaaaagcttcactcctctaagagaaaaataaatgaattcagtttagttcaatttagtgaatatctattaaatatccactgtgccaggcaaggtgctagaccctgggattacaagggtgaacaagacaagatatgctcattgttctcgagatcatgttcaatccagtgggagagaaaaacacatacatatttggttttagccaaggtttgagatctattttagagacaaagccaagttggaccaagttcttctctctattgctctcaaatcacccttttttgctacccacattgactcctagcacctagaattacagtaactggcccataggatactcagggagtgttgttagaaggaataaacttgaggattcagcaagggcctcctggaagagataatacgagtcacaaaaaaactcaggtgacaaagactagaatgaccttcctggaagaggaaactgtataagcaaaacacattagatataaaacagcatgttctaggggtgaattgagcacatgcaaaaaataaataaataaagcagaataagggtatgcaactgaagatatgagcaagggtcaggtctttgtattcatgactaagacagtgcactttattctgtcattgaaaatcattgaagtgtttaaaacaagtcacagggtaagatttgtgttttcacagaaaattttgttagaaagtaatgtgttggcttcaggacagcctggcactcagatcctatgtttgtcataacctcggtctaagtacttgagctcagcctaagatgaatggacactgagaggcttgaagtgtatgtagatacagtccatgaagcagcgccttgacaaccatcgtgaagtgattgggttaccacatagacaatgcgacatgtcatttactgctcagatctggggatgctgtgttctggtgtctgagagagtctgatggagctctgcagcttttagaaacagcaggcattattatatatagctttcagaaaccccttccaatcaggctcaccctttctgtcagttagagggtaaaatccatgtttcttagcagtcaggttgagagagcaaaaaaaaagagggatgaagacaaactgaattccagctactaatctctgagatgcagtatataaatatgccatattcactctctttcatttgaatctgccttcctgggaagagaccatatgtcataaaaaaattcatagtttcttttagattaatcttcagtaagaagccccaaaatattaaatctcagtgctctcacatttttcttctcccctcataaacaattcgattcaatttgaattaatatttatcgagtgctaacaaaatgcatggcaatatagtggatgctgtaatagaactgctacataaagggataatactcatgtcctactttaagaaaaggaaacagtctgttttatacgagacaataggaacaatatagcaataacaaccattgcaccacaagataggatcaaaagttatttaattctgtcaccatttattaaccatctaccatattcaaggaaaccaatatgtcctaaaccaaacttgaggaggctatgttgaggaagaccagaaaaaggaatatagattttgtttgaataagagaactgtgtcatttgtagagaaatagatttgtgctatacctcatgtatgaataaatggggctgttcctctcagccagacagaggtgaatagatcctcatttattgatttatctggagtgtttttgtttgtttgcttttggttaaatgaccttagaagtctttatatgttgctttattttgccaaattatgctacccaacctagcccagaattaggtaaaatttggttcagttgtttttccaaaaactccaatagataagaatacaggctctgtcattgcctggattcaaatccggactccaccactcactaggttattagatctctttgtcctccagtttcaccatctacaagatgaagataatcactacgtttacatcacatcaatattgagagaatgaaataaaataagacctgtaaaaaccttagtctgggactggcttatcgtgttcaatgaatgttagctatttttctcctataataatgtggaagaaattatcagatgcattcccaaaagcatatagaactatttgtagagctttttttttttcgtcaagcccacattttataaacagtagatagaccaattggatcgtggataaatagacagaagattgtagtgatagagagataaaataacacaggtggggttccctgggaaagattgtaaaaagatgtgcacgcaggaactttgttgggagggctcacaggaccagcttccttattcctatagcttccagagttttggaagctgatagcccttaaccgaatcactccctagggaatgctcttggctaaagaaagctacctcacccaaggccatgacccctttacacgagcagcctgaatccagtgattgaggtaggacaggggcccagtctttctttcctcagtttgagccaactctgaggagttatccagaacatcccataaaatagatgaaggcctttgggtgaaggcactgaactgtaacctgctgctgcccaatcctgctttcttctcttcctcagaggtattgatgctgagagtgtctaatcaaaaatcatgatttaatgaaactcataagatttactgcttcaccaaggacattcttaagaaaacctagcttttttttttttttaatctttctgtgagtgcctgtgtcagagaagaatatgagaatactagtatagcttggtttggtgctgacttgattcctgataagactcctgcagttttacccatcagagttttgtaccatttgtgcaaatatcaacctagtgaaaaaaggcaaaaacatgtacttagtgctattatgaaaataattttgacctcatggacccctgaaaatgtcttggccaatggattagaagtaaatatcctacatttatagtcctataaaagaacataaagaaagtagtttagattcttttaatacaccaaaatcttatttttaaaatgataccacttaccattattagaaccgttattaccatgatgattgaaatgaaagcagttaatctaaatcttcaaatgttggtgacaaaaatattttaaggttaatttttaaaataacttgcataatagccaaaaagtagaaataagtcaaatatccatcaactgatgaatacacaaaaagagtagaaattatccagcaataaaatgaataaattactgatacatgctacaatgtggatgaaccttggaaacatactaggtgaaagaagacagtcacaaaagaccacatattgtatgattccattcaagagatatccagaataggcaaatatatagagctagaaagtagactactggttgcccggggtggtgggaggagttaggagaagtgaggagttattgctagtaaagatgggccttttcagaggggatgacgaaaatgttctagagttgattttggtgatagttgtacaactccgtgaataaggtaaaaactcaattgtatactttaaaagatacattgtatggtacacaaattatatttcaataaaagtattaaaaaacaaattggtgctttgtgacacactcggcatagatagaacattaaatttcaacctggtcttaagtaactatttctcatcatatatgtaggagcatatgttgagaagtgatttttcagaaaagtgagaagggaattttctgactcattaaaattgcaaaaaaaaacacatataataacagtaataacaaggactaactattattaaattaagtgaggagctgtgctgtctgctttatatgtgattctccctgcaattccaagttagatgactctattctcatcgtgtagataaggaaacagacactcgagttttcaggtgccccattaacattcactactactttaaaattctgcttgacaagaattatgataggaggcaactccatttttgaataggtaaaaaagccaacttttaaacttcagtgtacttcattttaggtcgaaagaacttatactttcaattccactcaaaggtttcaagattcctaatagaagagtggtaggtagtgtacatgatagaagaggcagatttcatctaatagtgtactgtctaagaagatggatttgaaacagaaagagctaataacatcaaagattttctttgctaggtcatcctttatacattaattatacagaagtgccggcttaaatggatattcttgctctaagagtgtttttttaagagagggttctttcccttactctgcacttgagttgggagatattatcagagagctatcagagagataagttgatagagcaagacaaagtttatttcatttgtagtataagcttattcatttacctgaacaatgaatcatcattgtataagagactgtgtcaccatgacagctagggtaagatcatctctgtcctgaagctgcactatggtttgaaatcagatatgtattcataaaatctgctttaacttttaaaatttataagtttctcttatttgtgcttctaatgtataacataaagtaatatagccctacaatctactgctagatattcatttttaatatcattcataaataaatgttgcatgatgtataaaaaaaagaatttttcatgttgctctataactccattaaagacaacaatctccgaataactaggtagaataatatgcattatttttcacacttaaaatatttttatttttatttcctctaatttcaagggtactatttgtttactatttgtatctggtcttgttggtgcatacattttgctcagataacaattgggtattttttaactctttaaaatgaaaacattattttaaaatcaaggtggagggaataagatgggattgattagttaaatgggattgatactgataccatgcctgactcattctccacatcatttaatttaatccttccaatcaggagctaaaattgtctcatttttctgtcaattgctaacaacttttctgtcttccctgtataatgaaaaaaatggaaaactctatttcttttctgtttgcttgtgctttttttcattctgctgctttcctatacttgtttcttgtttataccatcactttttttttcctgagtcacctgtcctgactactatttttcacagtatctccagttatcacacgggttttatccagtcctaggttttgctgcccttctacccagctgtacagctggttcaaagctcacagctatggaaagtggattctatttgtttggtagccttttttttggcagactttgctcttactttatttcactttagttctctcctattacctaagcttttgaaataattttgttctgagagttaatttggttggtttccttctgtcctttgtttagttgtccttcactacttccagttaaattttcccttttctttaaatgtcaaacaaattattacttttccttatgaatatagtcagtgatcaccaaagttgatgcttatcttcatttgatccaataaaataaatataaggatcttatttaatacacacacgcacacactgcattaaaataaatcaatttacacaattgtgattctcttgcagaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgtaagtttatatgccctttcctaatatagtctgtttacttttattgtttttaatgtcattagagtaattctgtttctgccttcctaattttctgcttgtatttattactttgctaatttgatatcattatttaattgagaagtatttgctttgagtgtctagtttataacaacaacaacaaaaaagaaaacaaaaactttcatacctgactgttttctttctttcattgtcctgggactttaacatcatgcttaacgtccatgtcatgactggatgttataacatgggctgaagtatctttgatgatttaataattttatttaaatagagttctgtgtatctaaatggtagaattaattactacctcagtaatatgaggaaccagtgattctgaaatgactttatttccaaatggttttgaatgatctgatcatacttataaagaacaatatgggtttctttggagatatataagtacactctaaaccttttcctaaatgatacttggagaaaatgtgagctgaaatgcaaatttaaaactttagaaccaaaccgtcatccacaaattatatcagttcaatttgtcctatggatagtgtaaatatttctgactgtcctaaaccaattcatttcactgatctccttggttattgttttgagaaatttggtctcaaagtctctgttgtgctatcttcaagctactaattcataaagttatattctgttatttttttaaacaaaccttcaccactaactcatttggcagtcagtttcaatgaaaaataagttattaaagctactcaaaagatttttattatattcttattttctcactttacacattattttaaaagatgcaacttcattattgagtccttttttatttcatgctttatgagtttttttgaaactttgctgtattcagttactccagaataaaatgcaagtttaatattgtgaaaggaatattttatgccttgctatatttgctttgtagaaatgttatctattaatttatcaatgatatttttcacagtttcttcaacaaagaaatatagttctaaggaaaataaattaacctttcattgtctgatatataaagtagcagtgtaggagtatctactgatcttttaatttaaccaaaaagcttcataaaaataaaagtctatcagttctgaaaacaatttgtgcagtttagaaaaagcagtattttcaactccatttttaaattggaaaatatcataattattttcatttttctcaaggcctttattttcttttatctttacaaatttataacttaaaacaacttttgaagttatagaacaacgaatataaaatttttccattaagcacattatttctaatgctgaagaataatgttgaaaagtgttatacaaatattccaaatgtaatatttataaaaattgcaacaaatacaatctactaaaaaataaaatatgatgggaaattactacactctttgtggcagtaagcctatataaatagacttgaaatttaataaaataatattttaactgctttttaaaatggtaagcttataactaaatgtaatatactcatgaaattggcagataactgaaatttttatgcatacgtaagttttgttacatcaaatttaacaaccagactcttggcattttctgtcttatgtgattctaaagactaagaggcctaggacagtgctttttaaaatttagattggaccccagacttaaatagcaaattaggtaaccagaatattaacactctaaaaactgcctttgaaaagctgtagattatgtcttgattaagaaataagtctctgaatttagaaggtatcaattaaatggcaaataatataatcaagttttttttttttaagtctcagaactacttactgttcagaggactgactttataatgaacatggacattcagcacttaaaatagtaaagctcttgcctttaaagactttatactttcacaggttagaaggttcatgctgccttgcaattcaatacagtaagtgtggtcatgggggtcttaaaaagaactacagaagtaccaaaaagcagaggctgaagaaggcgtcacaaaaagtcaaaatgtgaaccaaatcttaggagaatttattacgctgacagttggaggaaaggtagtccagatggagaagaagaaagaaaaaagacatggaaatgcaaaaaagtgaatgggcctatcgatgaaaatttggggccataggcaatggaggggccaattttcctggaataaatgtaaaggtacctgagtggcactccaagaaatttgaaggtttttgtatagcaactaggagacaggcactgatttatttaaacaggaaataacaaacatagacgcatgtcttagaagatattattggggccgggcacggtggctcgcgcctgttatcccatcccagcactttgggaagccgaggggagcggatcacctgaggtcggaagctagagaccagcccgaccaatatggagaaaccccatctctactaaaaatacaaaaaaaaaaaaaattagccaggcgtggtggcgcatgcctgtaatcctggctactcggcaggctgaggcaggagaaccgcttcaacccaggaggcggaggttgcgatgaactgagatcatgccattgaactccagcctggtcaacaagagtgaaactccatttcaaaaaaaaaacaaaagatattattgaaacagtgtaaagaaaggaaggagagtttgaaggacaggaggactagtagcagacagaccagttaggcattattgcaataaaccagaatggttatatgactttaattagggcaatgacagttggaataaagaggaggagagagaaataacataaattaacatgttcattatatgttcattatgattcaataattaattggatattaattgtaaggaagaaggaggatttaaagatggcactaatatttctagattgaacaactggttaaatggagatgctgttaatcaagacagagaatccctattagagatgacctggctaatggtattagattacaaagcaaaattataaaagaagatattctattataacaaaattataatagacagatattctgtctcaaaggcaagataatgccaaatgatcattggcattctgtcaaaactttgtttataaattttagagcattctatgaatgtacttagcccccaaatacttttcacatttcctcttaaaaagaatgaaatagttagaaacctgcctactgaagatacaagtcaattcaagcaaaccctgtataataaaatacagaggaagaatggtcatttatatgaaaagggtgggggaggagccaagatggctgaataggaatagctccggtctacagctcccagcgtgagcgacgcagaagacgggtgatttctgcatttccatctgaggtaccgggttcatctcactagggagtgccagacagtgggcgcaggatagtgggtgcagcgcaccatgcgcgagccgaagcagagcgaggcattgcctcccttgggaagcgcaaggggtcggagttccctttctgagtcaaagaaaggggtgacggacgcacctggaaaatcgggtcactcccacccgaatattgcgcttttcagaccggcttaaaaaacagcgcaccacgagattatatcccacacctggctcagagggtcctatgcccacggagtctcgctgattgctagcacagcagtctgagatcaaactgcaaggcggcagcgaggctgggggaggggcgcccgccattgcccaggcttgcttaggtaaacaaagcagccaggaagctcgaactgggtggagcccaccacagctcaaggaggcctgcctgcctctgtaggctccacctctggtgtcagggcacagacaaacaaaaagacagcagtaacctctgcagacttaaatgtccctgtctgacagctttgcagagagcagtggttctcccagcacgcagctggagatctgagaacgggcagactgcctccacaagtgggtacctgacccctgacccccgagcagcctaactgggaggcaccccccagcaggggcacactgacacctcacacggcagggtattccaacagacctgcagctgagggtactgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaaattactcggagctacgggaggacattcaaaccaaaggcaaagaagttgaaaactttgaaaaaaatttagaagaatgtataactagaataaccaatacagagaagtgcttaaaggagctgatggggctgaaaaccaaggctcgagaactacgtgaagaatgcagaagtcttaggagccgatgcgatcaactggaagaaagggtatcagcaatggaagatgaaatgaatgaaatgaagcgagaagggaagtttagagaaaaaagaataaaaagaaatgagcaaatcctccaagaaatatgggactatgtgaaaagaccaaatctacgtctgatttggtgtacctgaaagtgttgggggagaatggaaccaagttggaaaacactctgcaggatattatccaggacaacttccccaatctagcaaggcaggccaacgttcagattcaggaaatacagagaacgccacaaagatactcctcgagaagagcaaccccaagacacataattgtcagattcaccaaagttgaannnnnnnnnnnnnnnnnnnnnnnnnnnnnnnnnnnnnnnnnnnnnnnnnncacataattgtcagattcaccaaagttgaaatgaaggaaaaaatgttaagggcagccagagagaaaggtcgggttaccctcaaagggaagcccatccgactaacagtggatctctcggcagaaaccctgcaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaatgaccatccagactaggaagaaactgcatcaactaatgagcaaaatcaccagctaacatcataatgataggatcaaattcacacataacaatattaactttaaatgtaaatggactaaatgctccaattaaaagacacagactggcaaattggataaagagtcaagacccattcagtgtgctgtattcaggaaacccatctcacgtgcagagacacacataggctcaaaataaaaggatggaggaagatctaccaagcaaatggaaaacaaaaaaaggcaggcgttgcaatcctagtctctgataaaacagactttaaaccaacaaagatcaaaagagacaaggccaatacataatggtaaagggatcaattcaacaagaagagctaactatcctaaatatatatgcacccaatacaggagcacccagattcataaagcaagtcctgagtgacctgcaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaacttgaccacatacttggaagtaaagctctcctcagcaaatgtaaaagaacagagattataacaaactatctctcagaccacagtgcaatcaaactagagctcaggattaagaatctcactcaaaaccgctcaactacatggaaactgaacaacctgctcctgaatgactactggatacataacgaaattaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagctggttttttgaaaggatcaacaaaattgatagaccactagcaagactaataaagataaaagagggaagaatcaaatagacacaataaaaaatgataaaggggatatcaccaacgatcccacagaaatacaaactaccatcagagaatactacaaacacctctacgcaaataaactagaaaatctagaagaaatggataaattcctcgacacatacactctcccaagactaaaccaggaagaagttgaatctctgaacagaccaataacaggagctgaaattgtggcaataatcaatagtttaccaaccaaaaagagtccaggaccagatggattcacagccgaattctaccagaggtacaaggaggaactggtaccattccttctgaaactattccaatcagtaaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcatatcaaaaagcttatccaccatgtgaaagtcaatgtggcgattcctcagggatctacaactagaaataccatttgacccagccatcccattactaggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgacattggaaatcatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcattgggagatatacataatgctagatgacgagttagtgggtgcagtgcaccagcatggcacatgtatacatatgtaactaacctgcacgttgtgcacatgtaccctaaaacttaaagtataataaaaaaaaaagaaaaggattctttgttttataagaacatctgcatgaaaatagctttaaagagaaaattcccttgatacgtatatattttacgtataattcagtttttttaagttgtatctatatataactttctttgaacgtatattttacctcagatgattttgactttttctcttgctgtgtaactataattgctatttgctcattatttgtaaatgttttttataatctgtgtcaggaaggatttggaggaaagagaggctgcgagggcttaaaaataagaagacatgatagataaaggttgggttttgtggggcagttgttggggagaggtttgtaatcttcaagaaaaaaatatctttagaacagtatgctacatggaagctatccttttctaatcaaaatacggacagaataggcattttccattaaaatgactttgccaattcagagacccacaaatcacaacaaagagcaatcagaactggttaaagaagatggtctggaaagcttgtgtgagcagtgcgagtccagctctggttatggtactggactggtcctcatgtggaagagaaacagaagggccatgggagccagtggccagaccagaaagcaatgtgacaagagagataaccctccaacagtgagtctttcagagccccgtttaaaaatcctatacatgtaatatataagacagtattgtccacatttcaaaatacactaaagtaaatgaagaatgagatttacacctaaatataagtagaaattctaatattttcttcttcaacttgagtgttttgcatgccgtgctctaggtctgacatattcattcactgtgtactttacacagtttattatagagcgaccatatttcaggcactattctttggagggccaattgtgaaacagcttcgctaattatcagtcccaaaaaaggactcccattccatgaggaaaacagcaaaagatcaatcatcactatgccagccaccagaaacaggagtccatatgtacttatgcccactgcatcctgagctactgtgtaggtccaccatgcactgggtacctatttgccaaaatccagtgaaagaaaacatattcacaagttatgtgaaatgggtttacttcttatagataattagcaagggacagaagtcttggatccattgtgtgtggttcctccaaggctgaagaaagctgaacaggaaagatgtagtcttgatatgaatgctccactttcacagctgagggaccctgaaaggcagtccactctggattatgtacttcaggggccacatgacatactgggcaaagctgtaaaggacatccagcttccagggaagagaggaacaaaactcagtctgtcccatgcagttccttcgtaactcaagctattcaatttcctaggagggacaggtttcaggcagtttctccctatctgaggatattgcattcccagcacattgtactgttattcttcagaactacaagcaagaaagcaaagagagctgggttggtccaaggccactcaaagaactctactgcaccaccaaccaaaaacaaagggattattgagaacagataaatggctacacaggaataagaccaagggtaaccaaataaggcatatagtaaaactcatatattgtacagacaccaagagtcgacagcacagcatgaaaggcaacaagagttgtagcagaaggtttttctggtatagtatgtaagccctgaactaaaatacatcaagctttttcaaagaaactttaagatctgataatggcatgaaaaccaagaaatgtgtattgtgggccaagatagaaggaaataaatgcacaaaaataggatttagatgagaactgaggccttgtttttacatgccaattctatgatgagattacaaagcacttatgagagattagtgaatgattagggtccgcacctaacaatacatatataattagtgttatgtggctaaattaatctgcataaaagttactgacagttcacattgtttccatctgattacatggtctcctgtctggttataatttaggtgctaagaaatcactgccttttctgagtttgacacacattcacatggacaactgttttataaccagttccagaggagggactctctcatttgaatattgctaggcaacccagtcttaaacttacattgaaaatgctaagcctcttggctctcaattatggaaatgagatcctatttacctaaaaagaacattaaaagatatattatggtgcacactcatccattttaagagataggtttcatttaaaatataatggcagtaaatgttcagatttttaaaaaaattctcatgagtaaacttcttttattatattttgaagatcaaagcaaaatagaagaatcatttattgcaatactcgttaaaaattttatgagtccttgattttaacttctaattgcatcgattttgtgttatccatggcaaattttggttttgtttgtctgacagcagcaattcagtcgaaatactttgttgaaatacagagcctcattattgacaatatataatctgcataattacagttctgttaacatcttaattctgtttactttgcattcataggacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaagtgagatctgcctttaagtactttcattaacatgagtaaatgggattcgtctggagatcatgcttaaccttttagtaaaacatactcagaactttcactcactttgtctcttaaattaaagagttggtgtaaaaagtttgcagcgagaaaaaagattaaaggtttcaattacaattatataataaccaatgcactgaataaaaggactcacactgaaaaatgttactgatttctcggattctaaagaataaaactttatccattgaaattctaccacaggattctctgtcatcaagtcactgctggtggagctgacactgtgctaagatacaatacgtggtaaaatgcattttactctaactctaccctagttcaactgggtctaagccgaaaaattacttacactcaatttttctttaagacttgaccaagctaaaaatggagggggtttgactgctttaggcacaaaacaggcacttaggtagaaaatcatgaaaccaaccgtgttagtctgttttctcgctgctaataaagacatatctgagactgggtgatttataaaggatagaggtttaattgactcacagttccgtatggctggggaggcctcacaatcatggcagaagtgaaggagaaggaaagtcacgtcttacatggtgacaggcaagtgagagcatttgcaggggaactcccatttataaaaccatcacaccttgtgatggtcactaccacgacaacagtatgggggaaaccaccccatgattcaattatctccacctggccccacccttgacacgtggggattattacaactcagggtgagatttgggtggggacacagccaaaccatataatctactaacatagaaaaagctacatatagcagcatatatagaatataagaacaagctccttcagagaattcactgggaaattcaaataaaggaaatggcactttttttaggcaaacctaaattcagccacataagaataaagaaaagtgagaaaaatagcagcattatcagaatgctatgatgtgaagatttaaataacttatttttcagtaaaaaaggtgataagtaaataaaccttggaaaagtgaaaaacaacaaaaatccaagctggataaaccaaattcatctattaagaaaagagctatgccacttgggaaaaaacaacaaaatcactattcacacacacacacacacacacacacacaacaatagttctatgatagatgctatgctagtagtcaatcaaaaccagtcaaatgtattgaccattataattcgctgatgaggaagaaatcgatgcgctaatactaggtttcctaaattcacaggaaaacagtactcttgatccagcaaatgtttgatagattaattcatgaagagaaaatctgacagtttttatatactttcttcaatataaactttttgtaaaggatactctaatcatctaatacaaaagatatattcttaaaaattagtagtctccacatcttgagcccatttgtcagaaagcaaatccacaacaatggagatggaggagcaacacacataacaaacgggagagaatatgtgctaaatgcatggtaaaagtcttctccaataactgtttgaggtgtgaacaccataaacatcagcttggatcataggcatagagacccagaatcttaatggtacttgtctgggatggtagtttcagaagggcatgaaactcttatgaaatatactgcttaggtgaactgacaatggcagatgttaagcatatgatggaaagtggggattaatgcaataccaaaggaaattactgcataaagaattatttcctgaaaagccctcatctatgaagcttaggaaacaacagtttgcggtcattacagagtgatttttagtaaaacaaatgaaaaagattttaagattatcatacacaaaggaaaaaatgattgataaaatggtagcttcatcaaaaattttgaaaatagatccatctggctcagtcatatatactattaagaaggcaagccaaactttgagaaaacctctatattttatttgtacaaatcacacacaaaaaagaacctaaaaaacaaaaacaagaagtccttgttacatgtaataagccttttgtctcttcaatatgtgttttaaagaagaggactctactcttctttaagaggctgaggcaggagaattgcttgaacctgggaggcagaggttgcagtgagctgagattgcgccactgcattccagcctgggcaacagttcaagactccatctcaaaaaaaaaaaaaaaaaaaggagaggactctaagaaatagaccttggaagtcatcattatttaacacaagagaatactgagaaactccaactttcttttcagcactcaagatttggtgtgtcacttgcaagtggttattttgtttcgattttgtcctaagataacatttgctatagatttgtggcaagcaagaaattttatgttttacatttttgaaagcttctcaacacctacagtaatatactacttaatggcttatttattaattgctgataataaaaccaataggaaataagtagaaagaaagtgattgaaattataagaacattgtctttagtacaattacattcatttcttctctgatatcactgttaatcacaacccaccaatctgtaaacctaaaacaatcttcaatatattgcaaaagcaatgaaaaatctgcaatagaaagaagcaaatgtagcaaatgttaaagcacttacaatgatgggttaggatattcacaagcagacaagaaaattcacaagcagagggggaaagtctctaaaagcatattgaacacaaaaggatatctatagcctggataagatccaataaaaatgatttataaaatcacagaatacataatattttaatatttataaatatctgcaatacatctagtccttctaacctaagtgctaatcagtgaggaataatcaaatgccagtcacagttctcaagatattttccgtacagtttgatgattaagaatctcatgaaatgccaagtgctgtttgttcgtgtgttagcaacattcagcattgtctaattcagagaaactctcccttttcccatgattttagaacaaacccagactatattgatttactgagaaagatcaatcagcacatgtccagcaagcagagagtaaaatgtcattggcccatcttgcttgtacagaaaaaaagacaaagtaaaactatacacaaacatgctgactttattttttttgtaacttttttttttaggttcagaggtttatgtgcaggtttgttgcatgggtaaattgtgtgtcactagtgtcactaaagtttggtgtataaatgatcccaccacccaggtagtgagcatagaacccaataggtagttttcaaccctaaccccacctctgtctagtagtcccgagtgtctatttttcctttctttatgtcaatgcatactccatgttttgctcccacttaaaataacatacctgctgacattaaatctagagtttcaaagataccaacagaggaaataaagtcataactaatgcttaatcgctagtttcatctctgatgtgaaaagaatgcttttgtccttcaacagtaaacagctaagaaggaaaacatgataaataccagacaaaccacatgaaatctttatgggaaagcttacttattcccagtgtaaaaagcttcacatcaatggcaaataaagtgaaaacattaccggttatttatgctgtttgcaacagaccctattggctgcccattcaacctctcttgttatttcttcctggctaatgaaaccttgaaatttggatgttttcaatgagctcagatccaagaaataaatcaggatttatatgtcagttatagttataccactatccttggacacttaagttttacacttaaatataatagaagtgagatgaggaatttattggaaaatttctagttgaaatctatcaaaaataggtttgagtggggagctttctagtactggccctttcactttctttattgctttgaatatggttttgggaggacataatgcttggagctgtgacagccctcttgcagacatgaggcagcaagcctaaggagttaaacccaatgctgagtatggccaagtaggaagatctaaagagcctggatctcagatgaaattgctgaatttctgcatcaaaacagaaacttactcctgttttttatttcctaatttaattaagtgttttatttgcttaagcatctgagtgttgggtattatgactctatgacttgtatctgaagacattctacctgatatagtaatcaacaaatatgaaaacttccatattaatagataacataaatagagaaataataaaatgaggagtttaagtattgtgtccccacaatcacacaaactaactaggtataaggatactataaacatacagttagtttggggccccaataatcatacattttacatatattcttaatattataagtcactatgttaggtagtggggataaaagtgcttagggtctcaaaaggaaaaatagacaagtatgattgcatcaaactaaaaagcttctgaataacaaaggaaacaatcaacaaaatgaaaaacaacctacagaatgagagaaaacacttgcaaaccatagttttctgataaggaattaatatgcaaaatatgtaaggaactcatacaactcaataataataataacctggttaaacatgggcaaaagacctgaataggtatttctcagaagaagacatacaaatggccaacaggtatatgaaaaggcagtcaacatcactaatcgtcatggaaatgcaaataaaaacgcaataagatatcacctcatacctattagaatggtgattatcaaaaagacaaaaaatagcaagtggtggtgaagatacagggaaaagtgaacttttgcacattgtgcatggtaatgtaaattggtacagctatcatggaaaacagtctagaagttcctcagaaaattaacgatagaattaccatatgattcagcaatcccacttctaggtatataatcaaaggaaatgaaatcagtatcttgaagagattctgcactcctgtgtgtgctgcatcattattcaaaatagccaagatataaaaacaacctaaatatttctttttgaatgaatggataaagaaaatgtggtgtgcgaattatcattcagcccccaaaaagaaaatcctgccatttgcaaaacatagatgaacgtagaggacattatgctaaatgacataatccagaatcagagagacaaatacaacatgatctcatttacatgtagaatctaaaatagtctcatagaagcagagtagaatggttgttaccaagagctgcagggagagggaaatgggaagatgttggccaaagggtactaagttttagttaggatgaatatttctggagagctaatacacaatactaaatttaacaatactatattgtatgctagaaatttgttaaaagggtagatcttaagtgttctcaccagaaattttaaaaaagaaaggtaaatatgtgaggtgataaatatgttacctagcttgattgtggttatgatttcacaatgtatattaaaaacatcaaattttataccttatatatagataattttttgtcagtcatattcagtaaagctgaaaaagcgctggggagaaaacattaaataatcatgctattggataagtaattacaatctgagattctgtacaacaaatctgtgagtacctactgttttggtaggtactgttctggtcactggacatattccaataagtaagctttcttcatacagtttacagtcttgaggatggcagaaataaaaaataatttttaaaagataatctcagatagtgataaatattggatatacaacaaaaataaaagtgagtagctaccttgaaagacatggccagtaaatatttctttaataaggttgtcacctttgaagtaagacctgaaaattgtaaaggtaccagccaggaaaagatttgaagtcagaatcttcaaagatgagaaaaaaacaaatatagctcctaagatgagaacaagcttggtgtattttaaaactagtaataaagccaggatggttgataccctgagaggtaggggagagtgttaaggaaacaaagaaagaagagccagatgctgtaggaactcaaagggcatggaaaagagtagaaattatattctatctacaaaaggaagccactggaaaattttaagcaaagggtgacatatgatttgtgttctaaagagctcattctggctgtatattgagattgatttacagagaggaggggagagagatagcaaagagatccatttgcacaaccctagacaggaaatgatggtgccttagtttatgccggtaaagaagaaaatgaagagtggtgaagatatttgggatatcttgtggcagtagatcagcttggagaaaatatatatattatatgttatatattatatattatatattttatatatatatacacatacatatatatgttttttgtgtatgttttggggttttttgtttctctagatgaggaaattgaggcccaaagaaatgatttacacaagtcacacggctattccatgggagactatgtcagttagccattgcaataacaatgtttggggaaagtgcctgtcccacaatcaaatcctccttcttccccagtagtttccactgcaaattcttttctgtcatatgcaaactcccttcaatctcttacctctgagactcttgcagaagacaatggatatcggcagttgaaagtctttgaaggttgagaaaaaaagagaaagatctcatcattttttatgggtgcatagtattccatggtgtatatgtgccacattttcttaatccagtctatcatcgttggacatttgggttgcttccaagtctttgctattgtgaatagtgccgcaataaacatacgtgtgcatgtgtctttgtagcagcatgatttatagtcctttgggtatatacccagtaatgggatggctgggtcaaatggtatttctagttctagatccctgagaaattgaacaatgagaacacatggacacaggaagtggaacatcacacactggggggcctgttgtggatggggggaggggggagggatagcataggagatatacctaatgttaaatgacgagttaatgggtgcagcacaccaacatggcacatgtatacatatgtaacaaacctgcacgttgtgcacatgtaccctaaaacttaaagtataataaaaaaagaagagaaagatctcttagtctttggcgatagatgttacaaatgcaaacacacctcaaaatgttttttttttatttttcttaccagtcttttcaaattattctacagtgagtattgtacttttatggtaaacgaaagtattctacagtgagtattgtacttttatggtaaaggaaagagaacaatatatgttataaaactatagaaagaaatagctcctggcagagttccaaggtagccttctgtttggtatattaaaatttcttctctctggtattagttgctaaacaacatgtttgttttaatgctacttctttaatcaaaaagttggctggaggtcacttcactaggcaacatttatttttaaatgaaagataaagagattaaggaaataaatattactactactgattttttaaatggaattctggtcaatattccaagaaacttcagattcttccccagagtttaaaatctaatacctattcctcagtgtcaccatagggcctaccataagccccagaatcaacttttccgaacctataaataatgattaggagatctgaagctagagaaaatgctacagaatcttaaagtgtgtgtttaaagataaaaaattttaaatattataaaaatgtatccatatccttattaagaaataaatacctttttttctttttcatttactgtattttcctacctggctatccattgattggtctgtgctagctacttactgatcaggcttatataggtcaaacctttgcagtcatgatttattgcaggaaagcaaaagaaagcactgaaaaaatgactgcaaagagctttcctcaaactctcccttgggcctctctgtctcttcaagtaacagctctgaatgcatctatgatccatcaatattttcatatattcatatcattccctgttcacattaacataaacacacaaagtttcactgtacctagttttgcttctttaaacttgcaataagaacagggtattatcatatgaaacatacacattactcagttgtttaaccatcctcttaatcagtgtataatatgtgtcacaaaaaggcagctgctaaatgaattatacataaaggtaatgctttctagattactcctgcctgtatatattgcataatttaggcctggtccttaattttctttttatggaagctgaatcattaccttgttcttttagtagtccaaatgtttgtttttcctgtatgctataaaagtaaactttttaagagaagtcaacattttaaatttgtgtttatagcatgtatttttctaaaggctctttttttaaggaaaattttcaggctgtgtttcttagttaagatgaaactatgtttacttttaaaaataactgccactaaaggaaaagcataaatttgatagaaccaagttgttttcttatataaagtaaaaactaacaaagaagtcaaggaataaactattataccttcatctccaccctaccctctataggttccataatcaaggcatttcagtagcccaatatggatatggagtcattaagaaatggaaatactacagacataatatggtagagtaaacagtaggttataaacttggagctgtgattttaatctcagcttggccataattcagtgaacagacacgaatcattaatttgaaatccttgtacctcggtttccacatcttgaacagaattaataaaactgaccactctattttacagaatgttataagaacgaacaggataataaataagctaaattatagatcctagccactattgagactaacagcctaggagtcaccagagacacttattgaaaaatgcagatttccagtttcagcccctgaaattcatttttattcagtatgtctgagggaagaatagcaagaatttccaatctggaaattcagatttttaataaacacccaggtgattgtgaaacaggttatctaagagttccatcttgattaactgccctactacaatctagacacatatccaattatttcctcctccagccttacacatcattagataggacagaagtcacaagcaggtaaaagaattgtcaatacagtggaaagggggaggaaataggaaggaaaaggagtgaataatgggaaattagagctgttctggttacactaagcatactgtacaacataaattaataatttccctggcattattcttagcattatgcttttctatctcacccacacacttttagtttctattataagatagtttttcatgtaaaacatgctttataatgaagagtgagactatgagccctgatttttttctctggtgctccttttgttgaatttagtattttcccttttgctacctttttcttgcattttcttctctttaatgtatccatgacaattatttgtctccaatatagaccaatgtaaaaatgtatgtcccttccatggcacttactgaagaccttaaaattttgtgaaaatactttaaactatgatataactataacctatggccagaacatagacaacttttcttagacagtaatgtcattcagttgcctcaggtgcttaattttatctcagagtcttaaaacaattacatattatttcagattatgccatgaaactttaatatctctaaagtcaatggggttttaaggcacttggaaacgattaggttttgcttgaactccaatataccttacgggaaatagaagaaaccgtgggaattgcagtttcaagagttttgacctagaatatcccccttgttcgaaggtgaaattcatattccacattcaacattagaaactacagtaatctccagatcactttattaaaactgcacatgctgagggggaaaaagacataaaagcatgataaaacaacacctttgtaaaagcatcaaaccatgctaccaaagggtcatgatacatttgtataggtgtgccctcttgtggtgaatgaatggaacccaggacatttggaaagcgttctgaaaatcagggaagagcaattttgatttttgtttttctttcttagtttaatattgcctgagatagaaaatgtacatattaataagccatgataaaaaaggattttacttagtatgtatatttattaaagcttaataactctgaactatttacccagagaggaaggagcaaatgaaattgtctgctagtatttaactgcgaagtttcccagacttaaattgggattcccatagtggactttaatctgatttagtcagtgtttccatctataaaatttaagatataattagaaacaaaatcccagtaaaaagatcaaatgtaaaattagaaaaaggaattattaaagtgaaaaagtttgtgtttagaacaaatcaggtagaagaaagaaaggagtagagagaaacttacatggaaaagagaataaaacatgcaggcttttcggtgacatttttaaatgccaatgctaagttatcttgcatatgaatgaaatttatgcttttgagaacattgaagagatgatgaaaatgtcccacagggcaagagggcaactatgatttcagagcaaggtgtgaggcagtgagagtttctacatattggttcagtagcttgtatcaaatgtcctatacttcataatctaattgatacacatgggggaaaaaacagagagatacaaacccaacaacctgattgaactctaattaaggaagagaaaaacagtaaaaggttaaacctgaagagaatattgaaatataacgtaacacagtaattttcttttgtattgggaaagttaccagaggtcataatagcaattgcaggcactactttgaaaaataagtggtacttattatgcttatatattaatgaattttgaataaaatgattataaattattttcctgcactaccacagattatgctttaatatatatcatcacagagtttagaacacatttgttcaagtaagagcctcccattctatcaccaccattacagtttatttaagtactagaaatggcacagaaagatataaggcattttagcacctagtagtatcatacaggaaactattcgtagatgggtattgttcttattctgaaatagagaaatataaggaaatctcaagaacagaacattaccttttctgtgatcgtttaaattctgtttctggctacatattcttatgtgcatttttttaatttttactcttgaaaccctataaaacattgacagaaagaggattgtaacaaccatatataatagcattcattatgctcccttcagtattttgcactgttctcttgattttttaatatcactgtatattcattttcactagctatctaactttcaatttgtgagattaatctaggtcacattttcatcaatatagtttctaatgaaagtttttaaaaactcatcatgtcttgctactccctagattgtagccatcctgccattcacattggaaagaaatgaagtgcagaggaatctaaactgtgtaatttgaaaggtgttgagaccagattgcaaagttcctgtccctcagtgtatgtagcttgaatttagcttgcctggaacaatccaagataaaagagaggataagtgaggcggggcacaatttacaagagacaaacaagaatggaatacaaatgtggcacattctgacagaaatatgcctcattaaaacatcattctgtgagctcgcttgatttgcctgtattgtgcccagaatctcagctgccatagccagagagggcccaccagtacagacattgacaggtgacaatatctggagagtattctttaattctggattcattgtgatgacaaagggattacttaaaatagcctaaacctatgttatgaaaataaaatgaaataacattttgccatgtattaaattaaccataggcctactcaacatacaaaaaaaatgacatcctaatattaaatccctatttcttctaattaaaattagtaaaatgtatctaagacagtagtcttgttttgttctaatctgaattcttccagttttcaatgtctcttttctgtagtttgtcatttttatcaatacatttgctcaaagtacacttcagttacagtattttccactgaatttctaaggtgaaatttctaaggtgaattacttcctataataaagtggaaaatattagttccctgctctttttgtaaatccagaaataacatctctttgtgtggtgctgtagcacctccagtatctttctgagtcctcatattatacactgcacttttcatataaatggaaaatattgagaaggatttttggtattacattatcaagacaatttcagagtgaaaagaattgtagctaagattgtactccctaacgctggtcagcttacttggagttgtctcaagtccctgtgtttatcttaagaaagaaattaatgtagttcaacagcccctctactagctttgaacactgcagaaatcttatagaacattagcgtttatgtgggtggggccctattactgagacatcttataattcataaaacatcatggttctcaagatgcaaattcttctatttttaagtaaaataatcaggttttgcagacattcagactaaaaatcccagtagaaattacattaacctaggcaactttttaagaacacaaaactgggagaattgtaaaattctgccttgaagtgaaaccagtttctactttcaatggtaattattgaatcttagctggttattcttaaaccagatcattaaaaggaaaatcctacttgagtgaaggaatcctgatattaaagttgtagtgaggtttattttcatttcagtggtcctccttaagcattccttcccagtcagaactttctgaatatctctttggtgcttacacaaatgtatacaagcttgagggttatatctttgaatttcctcttatggatgtcctggtagtccttgtatacaaagtgcatgattggcatatacaaaatctgcacagctctgagactgctgctcagcaaatttgcaaaaagtgcttcactgtcttggtgaaaaagtatccctcttcccccagtatatactgaaatgtcaaaagcattgtttatgtatgattttggccaccaactatctgatagggcttccttataggtcctagtgaccctttgtagctcaaataagagattgaggtctttttagcagtatgtcaaaactaacagctgagggaaaaaagagaaaagagaaaaggtggaagaggaaggaggaataaatactaagcctcctttgctttaggcttaggtaatcagcctgtccctttatgtgaatatctcctgattcccacttttaaaatttttagtaaatgttaatttaacatgtgaaaaagacaatgaagatgaaacacgttttaaaacaatatgcagaataactaaggattaagcaaggtataaactggaagattaaaaagggcttggaggtgccctaagaaagggattcttctttagtgaaaatatcgtaggcccagtcacagaccctgtcccatactgcagtaaggacctctcacctgcagcgttcagactgaaggcgacaaaacaagccaccctctgagagaatgcatcccagttcatctcccagctcaattcatctctgacaatccagaataaatattctccgctcctccttcagctaatttcccttagagaagaattttgtgggagacttgaactatttctttaatcacaaaataaaataatctttagggaatatttaaagatgcctatttttatggcatacccctagcatctactgttaacaagtggaacaaatatttacttgaactaaatatccaccaacaaaaaaacagataaataaagtacgctgtatccaagtgacgagctatgtagcaggcactggcagtatgctgcctggggcttttcatatctctttaccatttctgtgtacacaggcttccaatatgcatgtactgcaacagtcagcactcagggccttgtcgaggccaccctaaagcctgctggaactcactttccctgcaggcaacaagatctgggaagcaacttggaatttacatcccaccagggtcagtctttgatcaatgactactaaggatatgaggtacaaaggctttagccctcttgcctctgaacaactctgaggggaaatgcaaaaagaaatacatgagaatgacaaagactaagttcagtgtaggaagtatcatggggtaggacaaaggggaaggaaagagatctggagaaggaacccctggggcttcagctatattagaaatatatatttttaaagccaagagttggagacatagttagcatcagattggtgtttatgtgacttttgtgtgtttgaaatagtttataatattttattttttgtggagcctttttttttctttttttatatatactttttttattatactttaagttttagggtacatgtgcacaacgtgcaggtttgttacatatgtatacatgtgccatgttggtgtgctgcacccattaactcgtcatttacattaggcatatctcctaatgctatcgctcccccctccccccaccccacaacaggccccggtgtatgatgttccccttcctctatccaagtgttctcattgttcaattgcctgcctatgagtaagaacatgtggtgtttggttttttgtccttgcagtagtttgctgagaatgatggtttccagcttcatccatgtccctacaaaggacatgaactcatcattttttatggctgcatagtattccatggtgtatatgtgccacattttcttaatccagtctatcattgctggacatttgggttggttccaagtctttgctattgtgaatagtgtcacaataaatatacgtgtgtatgtgtctttatagcagcatgatttataatccttttggtatatccccagtaatgggatggctgggtcaaatggtatttctagttctagatccccgaggaattgccacaccgtcttccacaatggttgaactagtttacagtcccagcaacagtgtaaaagtgttcctatttctccacatcctctccagcacctgttgtttcctgactttttaatgatcaccattctaactggtgtgagatggtgtctcattgtggttttgatttgcatttctctgatgaccagtgatgatgagcattttttcatgtgtgttttggctgcataaatgtcttcttttgagaagtgtctgttcatatcctttgcccactttttgatggggttgtttgtttttttcttgtaaatttgtttgagttctttgtagattctggctattagccctttgtcagatgagtagatggcaaaaattttctcccattctgtaggatgcctgttcactctgatggtagtttcttttgctgtgcagaagctctttagtttaattagatcccatttgtcagttttggcttttgttgccattgaaactggaagcattccctttgaaaactggtacaagacagggatgccctccctcaccactcctattcaacatagtgttggaagttctggccagggcaatcaggcaggagaaagaaataaagggtattcaattaggaaaagaggaagtcagattgtccctgtttgcagatgacatgattgtatatctagaaaaccccattgtctcagcccaaaatctccttaagctgataagcaacttgagcaaattctcaggatacaaaatcaatgtgcataaatcacaatcattcttatacaccaataacagataaacaaagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaaaagaacattccatgctgatggataggaagaatcaatatcgtgaacatggccatactgcccaaggtaatttatagattcaatgccaaccccatcaagctaccaatgactttcttcacataattggaaaaaactaatttaaagttcatatggaaccaaaaaagagcctgcattgccaagtcaatcctaagtcaaaagaacaaagctggaggcattatgctacctgacttcaaactctactacaaggctacagtaaccaaaacagcatggtactggtaccaaaacagagatacagaccaatggaacagaacagagccctcagaaataataccacacatctacaactatctgatctttgacaaacctgacaaaaacaagaaatggggaaaggattccctatttaacaaatggtgctgggaaaactggctagccatacgtagaaagctgaaactggatcccttccttgcaccttatacaaaaaagtaattcaagatggattaaagacttaaatgttagacctaaaaccataaaaaccctagaagaaaacctaggcaataccattcaggacataggcctgggcaaggacttcatgtcaaaatagtttatattttttaaaataaatatttagaaagattgataaggcaacaacaacatgcttgtcactaaaagttcagacatgttatcagcatattaaaaatgttaaaaaaaagatccagcctggtcacaattcttctttatagaagggtcatgtatccaaatttagagccaaaagaagagaagcccttaaaacacaattccataactaccaattattccacttctcccacggacctcacttttcctggtttttatctaactcatcaatacacacatcttccacatgtctttcttcacctgtcttcccagcctgggtcacatggtccaccatttaaagaatacacattggccaggcgcggtgggtcacgcctgtaatcccggcactttgggaggccaaggcgggcagatcacgagatcaggggttcgacaccaatctggccaacatagtgaaaccccatctctaagaaaaacacaaaaaattagccaggtgtgagagtgtgtgcctgtaatcccagctactcaggaggctgaggcagcagaatcacttgaaccagggaggcggaggttgcagtgagctgagatatcgccgttacactccagctggggagacagtgtgagactccatctcaaaaaaaaaaaaaaaagaatacacatgaatgccttgaatcatctgacgccttgccttgaattttgtccaaattcagccctagataacacattttccccccttgtttccgattctgtttccagcctcctgaatgttgctgtttatgtagcaaaactctatgaatttgaattatctacaaacttgtacaataggattactgtttgtaagcactttgaggagagagattgtgcttttattgttatttctatcactgtgttagtttgctaaggctgccataacaaagcagcacaaactgagtggcttaatcaacagaatttattgtctcaaagttttagggctagaagtctgagatcaaggcctctacaggcttggtttcttctgaaagttgtgaaagataatctgttttctgtctctctcctagtttctggtggtttgttggcaatccttgatgttccttggctagtagaagcatcacctctatctctgcctttatgtgtgtgtgcttttatatggcattctcctgtgtgcatgtctctttgtccaaattttcccatttcataaggacaccagggatattggattagaagcccaccctacttcagtatgacctcattttagcaaattacttctacaatgaccctatttctaaatcaaatcatatttggaggcactaagagttaaggactttaacataagaatttgagaggacaaaattcaatccataacaaccccctatgtctgagatcagaaccaatgagaggttgtctttccttgatctaaacacagccctctggagaagaggctttagttttttaattcaataaatatttcttcttcagctcaactgaagaactgtcatttctctttggacttgagccctgtatttccattagtgtactgttgtcatatgccctattctaagtagtttgtgttttaagtactttctcatctacctctttttattaaactggagagcattattttctacataatgtagccttgggacaccaccatattagtttccctaatgggttcttttgacttacaaatgccaggtttattttggcttacatatgaagtttgattgcatgcattcataattgagtttcccttgtggtttattaatcagaaccatcatatctcaagatgataattagctggcaagttatagcaaacatatacaaatttatttatagatatctcccactttctctctgcatattaacattgtctaataaatcatataactgtaaaagtgactgaatacccagattaaatctgttacttttgttgaaaatgtgacattatagaataagattcttaaacatttacagtgtctatggttttaattaatctgatgctctataatttgattctttaatattttgaaatgacttcacagatatttttaccattcagcatggaagggtgtttggttccacattaggaatttatgttatacaatatcacctcaggaaagatgttgctaaaaagacatagacacatttccatttttccatttacaatttaatttaaactgtagaaaaataaattatcatacaatacatttgaacatctttatatctaagtgcctttatgtaaataagaaaaagtatactttgtagagaacaacatgggcaaactcttaaataacctggaaaccatggcccattggaaagtgcagcagaccagtgcctgacagatcaaaattctatccccatttctcatatttgctctttttcatggagcaaattagactagtgagttacccagcagaagcatcctgcctttggatgctactttggaagctatttctgttcaagtctgtgttgactcgctcgtaacttcttggaactaaaagagcaagacagtaaatacccttgccttacagagagagcgctaaataaactataaattcctttgttaatttttctcacaagagaaagatcaccaagagaatggtcaccaaatttctccctcaatttgtgttattttatatttttttgcatttgcttttggaattggtctatgacaactcacaaaacgtctttgtggtaggtaactatagccatcaaaatgcttgagatggctgagagttaccaactgccctcataatcttgcttcaaagtataatgagagcaaatcagacctattctgcctcatatgtcaacatgtattaaatgaatattaacaaacaagtacaaaaccttcatataatttgttcaataaaatctatgactcccagatttttttataggggatcctcaaacatcttgcctgaaaaagcgtcaaagaagccaaaacaacatcccagtgccaagattctgtagacttattgtccaagatgtcagaaatcctcagattcactgcttgaaccgttggttattatttggggatcaggatccctccttcagatgaccagctaaccataggcttttctggatttctctaacctgattatgcaagaggaagaagtatctctgaaatattttagccagttgtcttgaataccactaattccaccaatgaaggcccacttctaatacccattatgctgattaagtatccactaattggctgggccttatggctaacacctgtaatcccagcactttgggaggccgaggtgggcagatcacttgaggtcaggagtttgagaccagcctgggcaacatggcaaaaacctgtctctactaaaaatacaaaaattagctgggcatggtggagagtgcctgtagtcccagctctcgggaggctgaggcaggagagtcgcttgaacctgggaggtaaaggttgcagtgagccagatggtgccactgcactccagcctgtgtgacagagtgagactctgtctcaaaaaaaaaaaaaaaaaaaaaaaaaaaaaaaaaatccactaagtcagccaatgaaaatccttttctaacattctgacattcattatgctaattattaaagcttctggtattgatccagtataaatagccaactcagttgtatcagtcccttctaaggtctgggcttccttttagaatgttagtgagtcatccctgagttgcgagatcccaaaggtacactaactgtaggctctgaagtaactttcagtaaattacaggcatcatagcattgtagcaagtctctaaaatactaagatctttcatatgtgtccattattctattgttgacctcctcttttactttctgttttgttttttttttctaatatatatacccatgttatcctttatgttaccttgcattctcgtttggcttctcttttttcattgtgtagatcagtgtatcagtaattatcttgcatctcccaggaaataagcttttttgtcatgatctagaatcatattttctccaagagtagtctctagaccacctgtttagaaaaaatccagggtacatttttaaaaatgcagaccatggccaggcacagtggcactcacctagagtcctagcttaggctgagagaggaggattgcttgagctcaggagttcaggtccagcctgggcaacatagtgatatcccatcttaaaaaaaaaaaaaaaagaagaagtagacttctgaggttgatctagaaatctgcaatttttaacagacaccccccactccatgatttttatacacatttaagtttgaaaccaaattatattttgcttgttccagtctagtagtaagaaccctattaaacataaattgttcaggttagttgtatttagtatttttacttgttacatctacttttcagcacattgtggaaccttcataaatattcagcaactgtaaaggaaactctcaattattcaggtgtgaattaacagctgatggataatccaggccctcagcctcttctgccttttccttaatgcatttgcctatttctctggaggacaaatcactcatcttttgcaacctattagcaagtttgatgaaaggcccagatcagattctaggcatattaaaatgtggttggaggattttctcttcaataaataccccacctaaaaaaattatttcttctatagataatgaagacttagctataatatccaccaaccaaacaagggcagaaaagactgacctgacccatttgctgggaaataaaagacctcaaagttagctttttaagttacaaggcatgtttctaaatgtccacataaaacaccataaatacagctagattatggagtgattaaatacaggataaaaaatggcttcccacaagagtttgaaaatagcattgactggtatccgtagtcaaaattgggaagaaatttgacaaaaatagacaaaagcaaccctttcttctcagttgtagaaaatataatatttgcccgtctctagtactcaggtcaaaaaagactttgccactttttttcttttatgtcttctgacatctttctttccatagagttttctcaggtctcctaggatattattgccaaacccaggctaacctgttgaatttatgcaatagaactaatgttttaggactattcttactcagtggaagactcttgtatagctgcagctgtctggttgtgcaacacatagggcccagatcactcactgtcaagtaattagggacaaagcatgggattcataatgccttcaaacagaaacaaaaatctgatttgaaagatgtctgatattttaatgaattttctgcaggcagcatagcactccactctagtttgttcactatccatataggtcctttgtaaatcaccgtcatcacacacacttctatttatatttctttctttgaaacagatattgtgttagcttctctaatttttccactagactgctgctattatctgtacaggacaccaaggccttccacaaaggagaatttcactcatcggatctaggagctgtggaatggctaaggacctccacgaacaatcatatttaaaatatcatagaggatcttctagagaatctagattagcttctgtcaggatccttggtggctcctatgtggtgtcaagtcagtcactgaccacacgtattttagtgtatctcctagagtctcggttatcccttctgtaaaaatgtaactgtacccttcatctcactgatgaggtttgtgctaaacttggccggtctgtatcacaaatagctccctgtgagcataaataacattggctcagaccatgagatttgagatataatgacaagttcacaagcagtcactttatccaatcatctcctgctcctctctctctcttaattctatattcccaggaaggctggagcaagttcatgaagggtgggggacagggaaggggaataatgacagatgacaagacgtaggacttctataatctgttcataaggaagtagtaattgagataaattcttatccagtcactgtaatactttttaatcaagcctggttgggtcttttgtttggttgcagagtagcatatgagagctgtgtgttggaaaatatgggtttgtgagagcatattcaattagattatgcaaatagcatagtccttgatagaagtcaaacataatatgcttaattcacatattaccttattattctttaatatcaaatctccttgctataatcttgctattgtttgcatggaaaatggtacttttaaaaacctgtggccttggatagactcagggcaaaataatttaatgctccttgtttgtttgtttaagtgttgtttgtaagcaagaattgttaagaaacagctgcagaagttttgggacaaaagatgaaattccagtatagattttcaatgtcaaaaagaaaaaaaaaagcagaaatagaagctatgattttgatcattttctagccaaaaggtttaacctacttctctatgtacactgcaaagttgtttagattctcatttcagtctgacacctttgactgccccactgtggctgccgagaacctgatttaggatacactatacattcctggattgcgcagtccatcactgttcctgaaaggatgagtactttgtgctttccagatgaaaaacaaaaaagtttcaaagaatctagttaaatcccaaataaatttagatccaaaattatatcattcatttcctgcccaaagggactaaattatataataagtctttttcaattccaatttcaagatctggttcttacctattaaatcacccaaagtgcttttacagggctaccaaataatattccagcttttaactctaaagaatgctgctttctgctgcatatttcttgccttcatcatgataatcccatgcttatctttcgtcttctctttgaagtgttttgttatgaccagtcctttttccaaactattattagttctgaaaaattagtggttttgttggcttttaagaccaagagtttatttttacttgttggtgggagtggggggtggtgaaggtggggagaggagttaggggaacttcaggtgaaaaggagaattgcactattaatgaacaacagtgaaggtcatgtggagtcaaaatagcaaaatgcatgatgaagagtggaagtgtcctgttgtatttctaccctactcttctttagttctaaaataaaggcaaaatggaaggacagagaagaaggaaagaaaaaaagagagaagggagagggaggaatgaagggaaggagaggaaataatccctttgaacatattggaatgagttcttcttaaacgctcttgagatggattttattgttaccattttgcataaatgactactcacaagatcatgtgagagcagaaatttattccttgctctaaaaagttgaactatgtattttttcttaaaattgactttgctgaaataggtttttcatattgaaatctcagttttgatttattagcactccaaagtgaaaatgttctccagtagtgagaaggaaatggaaacttcaccaggtaaaatttccccatacctcatagtagaagtgtgtagaactgagcctctttaaagccaaatgcctgtatatctggccctaaaatccctaggagggctgcctattaatagaactctgtagagaattctctttttaaatgaagaaacctctttaaagaataattatcctcacattactttcccaccagcagtttctgtttcctttccttgaagtcagagttgaatgtatttggcttgcaaaaattcaattctgagatattattttgataacgtctgtgtgaaagagtttaaagaaggaaggcatagagatgggaaagggtaaactaaaaaaggaagaagcagaggcaactggtgttactcgggaatgggatggcatgaacattccagcaaattcctgacataatacagatgagaagaggaaataaaataattgctttgagtggatatatccccattcacttttcatttgtggaagatgaggtgaattcacaattattagaatatgaacctcctttgtgattatccagccaaaggttcaggtttcctgccagcagcctaacctgatgtggtggaagaggcccaaaagggtaagatgaggctattaactctactctgagtcatatgtaagagcagatttactgtaatttgaggacagcgaacaagctttccccaaaagaagccctctctatcagggtaaactttattccaaagaccactataaactgggccattgaccaagtccatctttgtcagaacctatttgtccaggactcaatgcgcttctgagggcattgaggaatggaggactcatgccccagtatagcaggccaaggccttcttagccagctttagcctgtgatgtatctgaatgtctaacaaaaactgcctcttgctttcgcaataattttttagttgtagctactattagcaggactatattttatccttgatttggatgacataacttctgtagtagtatggcattaaagattttctggaaaactcttttaaaaagattccagaggaaaaagatgcattttgtaagatagagctgtacttaaaatgatgtatgtgcagaacgacagaaagaaacctaaaagctaagcacaacactataccaagaaaaataaaaactgaaatgattaggtagtgattcattgccccagaaataatatctatgtgaatggttatggaaacatgttaacaatgctgtacttgtgtttcctttttaagtacctggaatacattctgaccaagtgaacatattatctgaattctactacccacctaaggattttaataaggctacattggttacacctgctcattttctaatgcttcataaaacactcaggcaagaacagttgcaaagtacttattttcagcaattcagttttatccacgtgaacatatattctttaaagaatatttgggtacttcttgccatacaaaataattttcctatttaggaaataggacaatttacctaattgttttattaattaattatacctatagtctgccttttcagactaaaggagatgaaaacaaatattctctagacagtactagcttctgctggtttctgccagtgttgtagccctgtgacttagaggaatcaggacaattcaattactgagtttgaatcaagtctttgaaagtacagtacagtggcttctgcttattgcaaccactttaggaaacggttatttgagcctaatagctgactgattcaattaaaggagacaggaaaaccatttgctaaggcaagcattgtgcttgttattcactgctatcatctaaagcgcatctctgaaatcacaactttgtaagccaatggctctacatctttccccttctctgtctatttggaggctgtggcacaaatagccatttttgacttacttcatcgggaattctcagccaggatgtggagtgggcatctgaatttggggtgaagttacatgagcaatttgaacagtacaagattctaatacatcaagacacacagccttagggggatttttgctcccaaacagatgaaaataacatctaaggggcctatgctttgcgggaaacaaactaagaaacaacagcacattattattctgtgtacacctaacaaaacgtgtagaaagcaattagagacctgcatcaattctggtttcatcgttaaacaaaacatgcagaacttgaatgaagatttaaagagtatcagaaaccaaacagtgtcaggtgcggtagctcatgcctgtaattccagcacttgggaggctgaggcaggtggatcacttaaggtcaggagctcaaaaccaacctggccaccatggtgaaaccccgtgtctactaaaaatacaaaaaattagccaggcggggtggtgggtgcctgtaatcccagctactcaggaggctgaggcaggagaatcacttgagcctgggaggtggaggttgcagtgagcagagatcttgacactgcactccagcctgggcaacagagtgagactccaccttaatataaaaaagtaaataaataaaaaccaaacagaaagtgacatcccaaagaatctacataatataattcttgttttgaactttaaaagaccaatacctaacttcatcagcctaactttataattgcttatatgatacatgtggcaataatctttgatctgaaacagtcgttacccataaactctgaatatatatttatatatcttataagaataacattaatttttccatcagatcttttaatttaacttcagaaataattacatagataaattgaatcttacatcaaaaaatagactatcatagatgtcagcctgtagtcttttaaaaagtaaaagaatgattgccttttgcaaattctaaaatgtatgcaggagtttaaaaaaagtggaggaattaaaagtgacatgatgttcggtatattcttaaggtacagctaacagcattcctattgcattggatgtgagagaaaataggcatgacagaaaattccaaggcttcctgggcaatctgaaatggaagaatgcagggaggagcagtcgtagagggggaaaaaattgctaaattttggatatgttaagtttgatgtgccaagtgaaaatattgagcagaaaggctggagttcaaggaagggatccacactagagatatgaatttggaagtcactggcacatcagtgatatttaaagccatgagactgaatgatattgccaagagaatgaggagagtagtgctggggcacaccaagctgagaggctgagaatatgaggaggaggatactgagaaggaattaccaaagaggtagaaaaagagtcagaaatgaatggtgtcatgggatccaagtgaaggaagtatttcaaagaggaatgagttattgaggaagatggggactgagaactgaccatttgatttagcaacaagaacgtcattgatgtatttgaaggcatagatttggtgaagtaatagagacaaaggtttaattggaatggaaaaatgagtgtattcaccctgaaactaggaagtataaataactctttcaaagaattttgttataaaagtaagcagagagatggagcactggtcacagtgaaaaatgagatcagcaaaacttttttaaaggcttgtgtccaggggaaggaaaaatagatgacacagaaaaagaaagacaatcttactgaaattatatccttgagtagagaagagagactggagcatagtgcacagttggaatgattggatttagatgggagtatgaactgtttatctctagtactggaaggaaatagagtccctgggtcgagatgtagtcataccattttgttgaaggtctcttcagatagcttttattttctccatcatgttggagatgtaatcagctaaaatcgaggatgaagaaggagaggtttgcagtttagaagaaaggataagatacggaatcatctagaagactgggaaaataagtgatctaggattttgctgtacaatgtggcagccatgagccacatatatctattgaacacttggaaatgtgacttgagcaactgaggaactgattttttaatttaagtttaattaattttgattttaaaattgatactcattcttcatttttaaaaaactttaggaatgtttggaaaagcttcagtgtgtaactctggttttttaattgcaaattttataaaatctaaatacagatcaagcattttaaatgaaaatttagtatccaaattaagaagtgctacatgtgtaaaatacacaccagattaacatttacattatatgttgaaatgataatatttaaatatatcatattaagttaacattgattttaattttacctttttctgtttttaatgtgcttgctagaaaattgacaggatcaatggattcctggatttggtggagctaaaggattattggagacatcctactagaataagagataaagacaaaatgtgaggccaggcatggtggctcaagcctgcaatcctagcattttgggaggccaaggtgggcggatcacctgagttcaggagttcaagaccagactagccaacatggcgaaaccttgtctctactaaaaatacaaaaattagccaggcatggtggcaggcgcctgtaatcccagctatttgggtggttgaggcaggaggattgcatgaatctgggaggtggaggttgcagtgagccaagactgcgccattgcactccagcctggacaacaagaacgaaactccatcttaaaaaaaaaaaaaaaaaaaaaaaagatgtggttgttgaagagtaggcttcttgaaattgaggttatggaggcaaagcagtttggtaatgacaaggtccagagtataaccatggaagtgaatgactaatataaggcagaaaagaagaggagttaaaagaactgtaattaaacaggaatgttattacacagattataatgtcaatatgaattaaggggacattaattcgtattaatgttcacattcaggacaagatgaaggcaaaacccaaaatacctgaggttatttactcttagggactgtattcctggagggaggaactgtattcagttcctgaagggagggactgtagtcagaaacaaagtcttcaagaaatgaggggtggtgacttggagtattgataggtgactattacagagagggtggtgactggaaatctggtgccttgaggttcaaagtagtgtgttttaagataggatgtgggaaatacctctcccagcctagtgtatatggcatataggactaaagaaaacagccatgacatgaaaattgtgcagaggaagatgtgttctcaaagaaaacttcatttttggttaacagtaagttgaacaaaactttagggaaaagattgatgatgggccatgaggttcagagggtgcagttggaaggctctcagttttgaagactacaaagtagaagttgaggatggacccagaagacgagcgcttccctgtggtgaatgacagagcagggataaagggccaataagatcctgttcctgctattcttaatgcatattgtggaggcaaggctgtgaatattaagggtatctgaagcccttcttcacccctgctgtgaaagcagagaatcctagaaaggtgatttaattataactttattagcctcttgacctgaaagtttagaatctaaatctagagaggtaaagtcttctgtatgattgtgtttttgtaatttctgtcagaactctaatagttttgctttatatattttgatattggctatttgatatacaaaaattatgattattacttttatatgaataatacaagccctgatttcacttttgttttgattgtcctgaaatagttttatatgtgtttgtatatttatgctgcatgagtcatgttgttctagatatatgtcttacaaataacataattaagtcagtgtgtacctttgtgtgtgcatgagacccaatctgaaactctatcttttaataaagatttcaacccatctctatttattgtgataactatatgcttagtgttatttctgccatcttagttttccaaattcttgtttttatgttcctggttttgttatattagtcaaaataattctgcttgtttattatttattagtgattcttaagttatacattgcaatttttctactaatgatttccttccaattgctctttagatgaatttttgatctctacccactctgagaatggaatttgcccaggttttacttctctttccccatagttgctaagagtttagcaaataatctggaatctattcaatctctttcctcatttcagtgggaacttggaacccagagggcgtccccacacacagtcaggtagtttccctcagctggaagataatcatggaaaattatgagtagcatttgaagtgtgtgggttcctccaaagtgcctaaactgataaatctctatttataatatgtgaagtacattctgtggtactgctaggcatgaaaacaaggttgcaggaagctgtttaaaagcatctttaaatatctcatgcctgattaatgtactataatatggcacatgcttaatgaaagaatcattaacgggaatataattagatgtttaattcagtccctagtcaatcgtttgtttttaaatacacctaagagtaaacaacctcagatattttgggttttgccttcatcttgtcctgaatgtgaataaatggaaacctgtggcatgtacatagcaggatcagacacttcaatataccaaaatacatttcccggaaaaattcttccctgggacaccctagaaagggttttgaatttaaattgttcagtattacactcttggtgattcacaaagacacattaacttattaaaggttctcagaagatccagcatgaagaaacctgtttaaccctttgtgacccaaagtgatttgaccaggcaaccttttgcttgccttacatgggcaatttattttcagtggaacatattttgggaaatgctgctacacggtgttctgttgtaaaatagttaaaggaatcactttcccatctttagagttacattttattacagggctcccaaagtacttcttatgtctttgaggtcttatagagttttaatgaaaatctctgtcaattttgactttgatttccctttccttctatcctgctcagatctgcaaacaactcaaatacaaacgtagtggtaggaatggactgagaaattggagccacagcatgtgtgctcagaatcactcttcttctctgatagctaaggatttggtaacatgccaggctcctaatgttcattctctcatggcttactatgctctctctgagagattcccatgtagaaacacactttcatcaggcccagcccacaagcatgccaccagccattgctgatgttatttaggacctcactacaagtgtgtacatgactgtctctctgattagactctcagttccttgagggagacatctaatgtcacttttatttgtatttctctactatttgcaatatagatactcaagtgtgactaaatgaatgaatcactcaacaaatgtgaaaagtgaaaaacagttgagtttgccaacctctcagtaatttcagatttagacatttgacataaaaatggcaagacatgacttttactgtattgtcatggtttctttacatatcagtgtccctttgtctaagaccaaactaatggcagagatcatatccccagtgtcaaacccagcttgtggcacaaacattttttaaataaatgaatgaagaacaaatgaatgttgggacttggaaattctctctttgccattcaaatatttagcacacaaggtgtttaaatgaaagtggacatgaaattaaaagtactttttacaaaagtgaacaagtaaaaagtctttgtactttcatgagtttcacttttgtaatgaaaatctatcaagcagtttttataactgctctatcacacacaagcataggaaaatatacaaaattaacatcagggttaacaaaaggcaaataagtaaagacaaaaatgataagacattagatttttggaacaataagaaaaaagcaagtagtcaaatagtgaaaaataggaagaggaatttacagaagaggaaatacaaatgacaataaatatatgaaaactgttcaaacctgctagtaatcagaaaaatgcaaactaaaacaaaactgtgttttcaatcatcaaactggcagaaattaaaaagatttataatatccagagctggcagggataaatggaaataagcactttcatacactgttggtaagaatataaattgataaacctgttttgaagaacacctggcagtatctcaaattttcaatttgcaacttttagccaacaaggactctcttctacagaaatactttcacatgagaataaagacttatgtaccagatattgatagaagcattatttatgatagagaaaaatcgaaaggaaattaaatatcttcctatcaggaatattaaattcattattatacattcatagcatggatactatgcagccattaaggacagtgcaggcttcagtgggatgactttaaaagatctcccaaacatattatttaatgaaaaaattaaaagcatattggaaattaaaaatttgagaataataccacttatataaatgtatgtatgtttattgaataaacgaatctgtgacttagaaaggctctttaagctaccaaaatatgtggtgcattgatccttttttaataaaatacttcattataaatgaagaaatggtaccttaaaaaggcagcattacatatcctgaagcatgatatgctgaagctggcatgatactcactaaactcaacagttcctactgattgggagagggatgaaggggagctaacatgttttactctacttagttctgtataatctgaatctgttaacaaaaatatattacatatgtaattttagaaagatatctgctactagtaaccagaaggcttcttatagccattatataagcctgctcagcttaatatttatatgccaagctgaaagtttataactgattaaagagatataagcagcatcacacagtgacttttagaagctaaaagcagccaaattgttccttaagaatggaaagcccatctaattaagtaattaaaattaattaagtctacttctttccctcttgcctagtctgtggcttggatcacctgttaagctatgaggcagtacccaaacttcatgtaaaactctgatcatcagtggaaagtgaatgatgtgatgaaaaccatcatgtctttaaacaggttgaagatgagtagagaactctgatccctcaatagatcatttttcaaatcacccttggaagctaaaaatgaaatgatttaaatgaagtaaataattcctagagattaataaggatatctagaattgttagtattgacaacccacctgaaacattcctttttttctatatataattgacccttctacctattgacgtaaagaacagaccaatatctatcaggccatacaattttacaatgctgagcaagtcatgtctcaatttcctccatagactatgatccctcattgctcatcttgaaaatccttttgcagaagtaatgatctccctattacattgtggttgaatcatttgtgctcaattgagggtgcgtttagttcaagcaatacattttccagcagtgtgaacactaacacagaagcccaccgtgcacagtatatatgtcacatggctatttttccagtgaagggcactgaaaaactagctaagagcttattttcctcttgatctgtcatctgtatactctatggacaacttgtctgtcactattcaattgttcaaaacaaaattcattctcccgtattagactacaagaattgataaacagagagatgacccatctagttacagctgaaatgtaacaaatgtcagtaatttgctgtaacctgactacagcttaataacaaataccagctacaacgaaaaccttcctattttgagttcattctaagatttacagaaaattttataatgctttattagatatcatttttattgtatgtacctgcatttgtcagtcagaaacctctagaaaactttgtttctcctttgagaataaaaagaggtcttaaaatgcttttgaattataatttttaattaagctaaattcttctaatttcagataactcagatttcattggcttcatgctcctgtgaatatgtataattttaattgaattacagtgatattttagtttcctgaccattatattaaaaaagagttgtcttttctgtagttgtctgccttatatcattacacatcctcttatatatgcagtaccactcatttaacaaaaatagtttctagtaataactgttaattgggaaaaattacagaaaataaacagcataataaccccttatacattagtacagatgtagtaactataaaaaggataatcaaatcaccctctgaggtattcaattgcttttcatatttggaatagaattaaagtaacgaaaaatgaaaccttacaattttacagagaggagagtggctggcaaaaataagcttgtcatggtttaatttgaagttttctagcttactaaaaattttctttttgaattttaaattccctgaagcatggcaagtcttggggcagggtggcttgagggttgataaattcggctgctcaccaaccccacacaaggcccacgtacttctttctatatttctcctttgcccttctgtattcggtttagctctctttctggctgcaagatgaccgttgcatttctagtcatctcacccagacttaacatttccagaggaagaaaaggaattgttcattaagctgtcccagaagcaccccagctgacttctcatgctgcattagctgaagcccattcctaaatcaatcataggcaaagagaatgggattaccacaaaggattttgtgaatatggctgtatggaatagggtgattactcaacacacttaggtgctgcttgaaaagaagaaataataggtgaatgttcattagatggatattaaacagtaactgctactccctttaggtactgcttgttatatacatgtctacctccccatgaaaatatatgttcactgagaatggatgctactttatatccacattagtatgtgcttaattctttttcgtactcagcacgtttcatatttagcaaatatttttcaattaatgaatgggtaaattaatgaatataagaataaataatcataagaaaagaagcaaatttacagtgaagttaacaaagcttaagatttaaaggcctttggaaagacctaggaaaagctttagaaatgtgttcatatgataatctactgttaaaaattttacaaaaataagacattttaactacaactggctaaatttgctgactctatgctgattgacttaccctccaccacatttctgtaagtgtcgaagtgaccattttggaaattcagtgatcagaaagctgagctagagatacatttatttggaattcagtgggacatttttgtgtatttctcagtcacttccacgtctaataatgttatcgctaccacttggtataggaagggtttccagaaacacccatctgccctccatgctgaatcactgcaaagcgatttttaagaaaggtgcagagccagaggtgttgtgtttgagcatgccatagagtacctagcccttaaagaatgttaatagtgaaagagaaagattgaaagggagggaatcagaaaccagtctgtacaaaattctttcaatcatcagatacgtaaaattgtaagcagaggattcagttcattacagatccagtcaaaacagaagatctctcctgtgaaaaatatttttgataatgtgataatacagcgtgtacaattttaaaaaccccatacctttgttgtcacctttaacgggtattgcacgaaactaggtgttgtatgaaatggaatttctcagaattcctctatgtgtaggacacaaatctataacaatagtgctatagtaagtttgcctatgacagctgataaagaaatttgataggttttcccaaatttagcaaccacaagaaaaatttatatgatgtcactcataaaaagttataaaacagaaataaatttgtctagactactattaataaaccaaattttgactaacaattttgttatagaaaatgatattataaaactgttgtcaaatgaacaggtgagcaaactgtatgcatccaaaaatgtagtctcagtgcaagaacctaagataagaataagagttaattcctgttgaatgctttctaaagactttgcatttatttatttctttaaatgcatttatcacaactccatgaagaagtcactgtatcagcaggatgagctagattacactacagtgtcatataacctcccaaaccttagtcactatatttgtaaaggtttatttcttgctcattcttcagatcttgtagctagaaattgtgctgtacatggacataatgtagagacttagtatgacagaggcctccaccatctgaaatatctccagtcactgtaacaggaggaaagtgaatgacaaatagcacactgactcttaaaaactttgactggaagtgacacccatcattttcacctatattttgtcgaccaacacaagtcacatggccatgcctaacttcaaagtagtggacaaaaacaatccctccatttactcagaaagagaagaacatatatttgtaaacagcgaacgatgattactacaggtacttttaacacatggtaatatataggagaactgaaccatggagaaaaccaagtaactagccaaagattacacaataatcaaatgcaaatctaagattcatatctaggatcaagtccacatcttactattattctacctcctttgatgtaaattttttggtaaatctctgagccctggaatggcaaatggcattacactaagcattatattcttggtgagaaattatgatgagtaactcaagcaagatctgtacatcttctagtttagtgaacaatatagcttaaactctcattcattatattcattcatcaaacatttctaaagcacatttagaaattataaatgaatataactattcatttgtgatgcattattacatcaatttcatggagaaagataagagaaaggaactctctaatactaactggagttaggaattatctggagattaaagggtcagctattggacatctagaagctagaatgactcactgcaaatgatcaatagtctgcctttccttccttccttctctccctcttcccatacttcttcccatcttctctttcacaaaaatttattgcattcctggtagatggcaggtattaagaattggagagataaacagaaataagatctatccctagggaactcacaatcacagcagtaaatcagatgcataaatgcaatataagagtcaatgagacactctcaaaaccttgtgaaattcaaactctacatatatgcctgattttatagtgcaggaccagactgtaatttgccaagatatgtttattacagttctcagcctgtgaatttattaacatcttctctactgcataacaccttttggtttcattcactggtatgtttacagctgacatgcactatctttcctggcttttgtgcccacatttgtttacactgacacatggtactatagcttgatgcctagataagacttcaagtgtttttgctgaaatcgctcagaattattgtaaagagatgcatttataaccatcagggaacactgaatcttggagtctgtgttctttggcatctgttagtaaatatcttactaccctcaccagctttagggtatacattgtttaccagtggcacagcaaaaaatatctcccatattttgtggggggaaattctttctggctctcacagttctgagagttgtttacagccagctggtagaaagtcttacttgcacttcacctgcaatgatttgtgtgtcaggctttttgtctcttatggtgcatgaagaggacaaatgaaagtcctttcccctgcaatatctttcctgctcatgaaagttacttttccaaactttaattactggcatgatagcctatcttcattctcagtgtcagaagtcttattttggtttcttttccaattacatctttttcgagtgctttatatattttagtctgccgtagatccttcactataaaaaaaacaaagataacatttgtgctatgttacagcaactgtctagagtctattttatctcaatctgtgtcttcagttttttctatagaagtacaagtagttatatattttttaacatactattggacatcatggctataatgtcatattaaaaatgctagcattttgcaagaagttcaaactggaagcaaggtgttttttttcattggaaattgtcagagatcgtaacgcgatgaaatataataagcatagtctctatttcagaatgagacgctgaggagttatgacaaaagatcaaggatcaattaagttatttttatactgtattttcctttctgggcatgaagtacaactttccacatagtttcttttccaacagatgctatataattttgttgaaatgattaatgtaaacaaaacagataatttgttaaagctattggtgtgataatgctgcataacaggccacctcccaaaatcctcagaggctgaaaatacaaaacctttacttctcatgtgtgagtctgcaggtccactgtggcagctctacttaaaatgtcacttaggttcaggtttgctccacatttctcatcctgggacccaggttgcaggagcagcaggtatctggagcatgcctgtctggaggtacagggcaagaatgccagagtgattagccaaacaatgcaagcacgttaaagccctggttggaagtgacacatgttgcttcccttacattccattggccaaccaagtctcctgccaagctcaaagtcagtgaggcggggaaatatgcttcattcccaggcagcaatggccaagtcagggaagaaaggtagatagtattattgtgtattattgtgtataatacaacctaccataatatcagttatgactctgtcttccctgatatgatcattgccagtggaaatttctgattgtgtctttcaatgtatgtccagaaaactacatttatttcttcgagtatatttcttctgttatttggtatgtaattttctacttctgctagtctttcatgccttcaacctagatcaaagaatagtatgtgtttctaccacagtttaatagaattgatataaaactacccagtaatatgattctttctaaatgagattatcacttttgttaaaagtaacatgtacttgttcatgtcctttgtagggacatggatgaagctagaagccatcattctaagcaaactatcgcagaaaaccaaacaccgcatgttctcactcataggtgggaactgaacaatgagaacacatggacacaggatggggaacatcacacactggggcctgtcatggggtggggggaggggggagggatagcattaggagatatacctaatgtaaatgatgagttaacaggtgtagcacaccaacatggcacatgtatacatatgtaacaaactgcaccttgtgcacatgtaccctagaacttaaagtataataaaaaaaaaaagaactagaaaaaaaagtaacgtacttctacccactttgtttctaaatgggattacacttttttaaaaactaacttgtgcttagcctacttccaaatataggaaagaaataattatttcattaaaaaagtaaagcccctttcattcataaaagagctatacccccaatccttttaaatatctttgtatttttaagttttttattattcattgagtaaaccaaatgtatagattatgcctatcattaaaatgctcaatatagttttacctttcttcaaaattctcctctctataaactttgacatgcctcctatttgctatatttcaagcacattgtcaattttgatggaattatatcagctataaagatgttatagatatcagatattatgtgaagtaaatgcattttgccagataataccatctgcacctaaggaaatatgtgaagtcatatggaagttcacagaataataagtaaacttcgatgttcatattagagatcagcctaataatttgtgttcattcaaacatctgtgatgttcagctcattcacgagtcccaggagatgtggtactgccaataatttgtccttccagtgtaatagagtataagagtaacatgtgtgttcaactccatcaaaatggataatgtgctggaaaaaaatgttgtttgattttggctagatatataaaaattaattttatttagaagggtaattttttggcggggtgggcttgcctgtaatgcggtaggcaggcctctctatggccctgaaagtgaagcctctttagcgcttcctagctcccactccctgcaatggctgagtggccaggaacccaggatctagctccagaagctgagtgagcccaccttcctcattgctgcattttgtttttaacgacaattaagatattatttacataacagaaatgtcgatcatttaaagtgttaccatttgatgattttttttgtatatttatagagttgtgcaactatgactgtactctaattttagaacattgtcacaccccccctaaaaatctcatacccattagcagtcattccccatccccttcccgctctttcccagccctaggcaactacaaatctttctgtgttttctgatggtggacaaatgggatcacccaacacatggtcttttgtgacttgcttctttcgctaagcataatgttttcaaagtttgtctgtattgtagcatgtatcaatacttcattcctctttcttgcctagtaatcttccattgtatgaatataccacattttgtttattcattcatcagtgatgaacatttgggttgtttctgttttttggctgttatggataattttgctattgatcttcatttgcaaatttttgtgtggacacatgtttttatttatcttgggtatatccctagaagtgaaattgctgagtcatggtggagttaaacaggataactctgtgtttaactttttgaaaagctgctaaattgttttccaaagtggctgcactatttttatcatcccaccggtaaggaatgagggttctaatttcaggacatcctggctaacacctgttgttgtctatctttttcattatagccatttctaatggatgtgaaatggtatttcattatgatattgacttgcatttccctaattactaatgatgttgaacattatatgtgcttattagccattcatctgtcttctttggaacaatgtctacttttcgcccttttttttttttttggagacagagtttcactcttgttgcccaggctggagcgtagtggcacaatcgaggctcactgcaacctccacctcctgggttcaaacgattctcctacctcagcctcttaagtagctgggattacaggctcacaccaccatgcctggctaatttttgtatttttagtagagacgaggtttcgccatgttgaccaggccggtctcgaactcctgacctcaggtgatccacccacctccatttcccaaagtgctgggattacaggtgtgagccaccatgcccagccttgcccattttttaaattgagctatttgtctttttatgactgagttgtaagagttctttatatgttctggatacaagtctcttatcagatagtatatgatttgtaaatattatcttccattctattggttattattttcttgacagttccacttgaaacacagcagttttaattattataaagtcaattttattttttcttttaccacttgtgcttttggtgttgtgtctaagaaacaattgtctaatccaaggtcaagaaaattaactattgtgttttcatgtaagatttttatggtttttagctcttacgtttagatccatgatccattttgaattaattcttgcatatggtataagttaggagtctaattttcttctattgcatatggatattcagttggcccacaccatttgttgaaagactatatttcctccattgaattatcttggcccctttgtctaaaatcaattgaccataaatatttgtatccatttagttttagactctcaattctattccattgacttgtatgacttttcttatgcagtcccacagtgtcttgattattgtgtctttgtagcaagttttaaagtctgttaatatgagctcactagctttattctctttaaagattgtttcagctgttgtgggccccttgtatcttcacttaacttttaaatcaaaatacacaattatttttagccccttttttctgttgttggtttttttgcctgaattacatatagcctagtaaatgatttcataagttgaacgagtgtggttagggaaagggttactgacttctataaatatacatgtatttgcatactaaaacatctccaagcctccaagctttagatattatcataaaattcttgcttaaggaaaagtatatttttgaatttcatactctaataaccctaacacccaattcatatagcaacttatttatctgattgtactaaaatatccactgaaacaatagttgtaaattaacattgatgtaaacatgattaagtttggaagagcataaaccacatgacatcctgagcagaaaaaggagaaaattctctttcggccccttccagtattcttgccttgaacttttaaatacaaaaacttattttgttaacaaaagcaaccattctcctaaaaccagagaagagcagtcatgaaaggattcacaaaactagggaaatagttgcttattttcatgctttgaccaacaatcatggtcttcccttggatctgagtttattttggcacagaagtgctatggagaagctttcatagtgatcatggccctaagaaattaaaaaacttatatttatagatttaaagttagagaatttacactataaaatatggaatttattttcagtatctcttttgttgtataatttgttttttatttagattgtgtcctactgcatatatgttaagccaggttattttcatctgtcttttctttttctgttcttaataggtatgcaaagtttgtctgggtgaatataattaattcctctaatcttatgtaagtctttttcaattacagatttttttagaaggacttctggaatatgtaataaaccttttgcaaataatcagtctttgatcagaatttttaaagacgatccttggagggcatttgaaaaacaaggttttgttttattttttctgactcaggcctttttatggtacagttgccagaaatgtcataaatctcaaaaaggccattcttgtcctgaaccaattgacccttcagcgccgaatcctcagctacctcaggagtcctactggacctcactgccattttctgaataatttatgtgatttacagtgccttgtaaaaagcactgaaacatctctctgtgtgactcgtttgcttttaatttatagtgacatcttttcgtagtagtggaaacttgctgaaaaacttttctgaaacattatgtttttcattcatactcacatcactgtggctcagttttcagtgacctcaattttctgctctgttgtttttcaaattaaaaaatacatatgggcagtttcttgacaaagtcacacattaaataacattacccatagatcattatcctgtgtgcactctgccattaccaatggttacctgacctttagaattaaggagagcattatgagcatctattgagatattataagctgtaatattattagcatttcttagggtcagctgtaatgtttacattgcagctatgctggtgtctcggagaaggacacgtgtggttggtaagtggcccttgtcaagtcctcatgatggtctgataataataaagaaagtaaatgaggaaaatgctgtctggttcagtgagataggcatctgtaaagaagattgagcacatatgaagtactgtgccctgcaaagaacataaggagatgcagagggcctggcaggatgggtacctcatcatttaaattaggcaaccagggaaaacactgaggatcatcacctgaacaggaagaggcacatacattgttggcagaggaatttagatgtgtgggttaagcagagccagtatatatttaaataaaacagttttctaatcagaagcctgaaataaattaattaaattaaatcatatttagtcttcttctgaaggacaattgtttctagtatttgaagaatataattaggatgatttcatgaatgtaattatcagcaaaagtgattgcatcaagaacatatgaaccttgtatgtttcactatcgaattgggattttgtgtggaagaagaaatgatgtaatcccagcactttgggaggccgaggcaggcagatcacgaggttgggagatcgagaccatcctggctaacacggtgaaaccccatctctactaaaaatacaaaaaaattagccgggcatggtggcgggcgcctgtagtcccagctactcgggagactgaggcaggagaatggcctgaacccgggaggcggagcttgcagtgagccgagatcgcgccactgcactccagcctgggtgacagagcgagactctgtctcaaaataaaaaataaaaaataaaaaaagactattgtttagcaaggtttcagtaagcactcaataaatgttagctattattataatcatcatcatcatcattattattgttttcttccacctgatggttataattgtgcttggtcaagtttacattgattcgcatgaagctcttcattaaaggtaatagaaataaagaactcctttgtatccagcatattgtccccatacttgccctttattttagctatttaaatcacaaatggtcccctattaactttgattattttatagcaaacacttgaacagtcatcagaaaacctagtttctagttctattctgccactcactattgtgtgacctagagagaatcttattatttctgggccacagttagaatagatgtctatgagcccttttcttttatttctttttcttttttttttttgagatggagtctcccagttgttggcgtgggctggaatgcaatggcgtgatctcggctcactgcaacctttgcctcccaggttccagcaattctcctgcctcagcctcccgagtagctgagattacaggcaccagccaccatggccggctaatttttgtatttttggtagagatggggtttcaccatgttggccaggcttgtctcaaactcctgacctcaggtgatccacccgccttggcctcccagagtgctgggattacaggcgtgaggcactgcgcccagcctgtgagtccctttcatatctaatattctatggggtagctcaaggggcaaaatttcaggaaaaaagcattataatatattgcattcacttttaatctgtccttggaagtcacttcacttctgcctcaagcaagacccacatcttgtttgaggatgtcatttaagggtagcattgcaggctgcagaaacttccattgtatagtgtcagagttgtggatatcaaacatttactcaggattaaaaacgtggcttaacctacttggaactaaaattgaactttaagaagctattctataaccaagacatagatagttgttgtcttcaaactagattttactatttgtagtgcctttgaccttcatgcgaattccacagcaaatagagtcaactttttttaactgtttatccctgggcagtaccatctgatatgagtggtattccatcaaaatgtgtttttttcctgaggaagtcttgctgtaatacatcatcagcatgacagctagtgtattacatattacaataaaacatccccagagcaaaggtacatgtgatgatgaattatgataatatgttattgtcattatgttatcagcactcagagaatgatttagtgagatacatcatcagtgagtgaatatctgattttgtattactcaaaaaatgacaccatcatggaaaaccacaagcctgttcatttgattaatagggttagtgatattccagtgccagaactcatgtatggtggtatattaaaatgtcctttgaagctgaaaacaagttaaagaaagatgagtccatgaggtgaggttgtaaaagcactgtcaatttgaatactattactgtagacagagtgtacagttaagtataaaccaaaagtcacccttgtcttttattcaaacatttgacagtgatttagttctacttaattatctgtaagcctgataacttctttcaagaagctatctattgtaagaccaccgggttatgctataaatctacagtctacaggtgacactttatttatttaagacggagtctcgctctgtcaccaggcccgaatgcagtggcgccatctcagctcactgcaatttctgcctcccaggttcaagagattctcctgcctcagcttcccgagtgtctgggactacaggcaagtgccaccatgcccagctaatttttgtatttttagtagagatggggttttatcatgttggccaggatagtctcgatctcttgacctcgtgatccacatgcttcggcctcccaaagtgctgggattacaggcatgagccatcatgcccagcccaggtgacactttataacgatatgcattaatgcccaaaatcactgaaccaaaccagacatatcactaaactttgttgttgagtgacagctaatttattcaggatataaactgatcacttttcttatagaatcttcttttgcacagaaccttgtacacattaggcactgaaaagatatttaccaagttgaatcgatgatttttcacataactttctatattcaaaatcacagaaatcacaagtctgacaccaaacttaaattagaatagccagacaccatggattgcaaatagaaaacaacttcatttttccccaacactgcttgttccatcacggtctcatgagctagtcattctgtatcttgccactgctttctagctaaggtctcagacccattcatagtgtgaggggctatgagagggagaacagagagcaggatagatcttactccattggtgctctcttgatctggcattgatgccctctgagcttgctgagtaattaaaactgactttttctctcatggaattctttcacaggttctttgaggacctcctttcactcattatgcaagtttttcctcaagatgtcttaacattctgtaccttttagtgcttatgacttacgtttacctcattaatctctgttttctagctatcattcccttctgtattggcaccaacttaccctaataggcatcttatacttttggacaaaatccctttgaagaaaacctctaagctggccccacctcataagaaccatatctgattcacagaaaatagattcttctggcacagaagaatgtattcttctagcaaaaacacagctagatcctaacataataataattataataactaaattttactgagtgtgtactatggtccaagcgttgctacatgtgttaacttattaaacttcctcaaaagaggagggtagtattattatcctcattttacagatgaagaaactgaggcataaagaaactaatttacccactgtgacaagacccactgttgggaaagccaagcctcaaccattgctggccacagtgtcagtgtgcaggctctttgcgatacataattgtaaatttagtattagcactcaatactaaatttagttttaaaactagcaaaatatggttgttcatcattagaacaggtattaatcagtcagtgcctcacctttaagcttttccaggcatagactcaaaacaagttcgttgtattttcctaaacctcatcagtgaatgaaatttctccccgtggtcctattacagctcctcactgaatttgaaatgaggggcgccacaacactcaagctgtgttctccaaaaatagttatttgtatcccagccttttctaccacagtgatctgggtatggagcaatgggtaacaaaaccagtgtattagtttcattgtttttaaatttccttttcaagccttggaataatgtaggataggtttataatttagaatacttgcttattattagtttttctctccttggccttttggagcctcagccaaaattgagacagaaagagtactattttaacatcctttaataaaaataaaggacattttctgtaacccaaaaggcaaggaaatgagaatgtatggcttctaggaacaagtgggatgcttcttagtccgtcatgaaaaccttaaaagatgaatgtgtcacagacctcaagaaatgtttcagggtcatgaaaggcatttttacttcagttgatttatgcgtgcaatttcagtagggcagcctgtgctagagtgcttccagggatccactggttagatcatgatgaaggtggcatcaaactgtcactgttcaatttggcttggaggtgtgttatcaatttctgaagcatctaatatactcgactgagctgacaggatgtggcacattgtgggtcccagcaatcattttatgtcaatctgtcccataggttagggtgctgctggctttcctccccaaactgcttccacctaaaacttcccaagttgactcccaaaataggttgactattcacacctgttttatactcagcgcctggccctagttttattggcatgttaagagaagtgaagtaaaatattaatgatttttaaagacaaaaacaaagcattaaaagtagatagccaatgcatgttttttgtttgtttgtttgtttttgagacggagtttcactcttgttgcccaggctggagtgcagtggcacaatcttgactcaccacaacctccgcctcccgggttcaagcaattctcctgcctcagcctcccgagtacctgggattagaggcatgcaccaccatgcccggctaattttgtatttttagtagtgatggggtttctccatgttggtcaggctggtctggaactcctgacctcaggtctgcctgccttggcctcccaaagtgctgggattacagttgtgagccgtcgtgaccggcagccaatatatgttttcttcatctacttactaataaagaaatagacattttcttcagaagaaaaaaatgcatgataatcaaactgcttcacaatctatttcttgaattaaaggttttttttttttgtaaaaccgtattttgccaactacaaattcctcttccttgtgggaaggaagtttacctaaacttgtcttctgtctctgaaggctgaaaaaggaaattctagtgcttaaaaatgtgacacaataaatttcaggataacacaatagagttaatgtgtaaagctctgtacatttataggacatttttattcacggtattttattgcattttgacaaaaggagagcagtattatataaagaaaaagtactggtttgaactctgaagcctgcatctaaatcttgaatatggcaattatcgggcatgtggccctcgacaattttcctgctctttctgaccttcattttccttgtctgaaaatggtgacaatcattttattaaccataagtaaactgagtataggatctctgccttatttatttttgtatccacaagtcctcgcacggtgcctgccaaacggttcctgccaataaatttgtcatgacaagtaaatatgtctgtgaagaattattatctctcatttacagattagcagattgaagcttaagatgtttaaatggcccagtgttacacaaccagtaaggaaaatgctatggtcagttgtgagaacaggatcaaattctggaaattgtgacatatgtggagtccaaagcagaagcattaatcactgtaaaagagaatatccagatgcatatagacgagcagggttcagaaacacatacttctggttgttccattgtgataactagtttgctcctcttcacttcctgcagatactgacaattagtaacaagtactatgatgcagcccctcttggtgataaagaatataggacaggtataatatatagtttctcattttgaaattcaaaaatgttttcatgagtatattctacatagtgttcagcagagacactaatatgaaaaagaaataatactaataattattcttacatgagcacaacactgttgcaagcactttgggtgcattctctcctttaatccacccaacaatcctataaggtactgtcattatcttcacttcatagatgagaaaattgaagtattgagaggtaaagaaatttgctaaaaacctcagagcccataagttgtggagctaggattcggatgtaagcagtgtggttcaagaatcttaactcttaacttctgtactttactgcaccgtgtggtgggtagagaaacataggacacaataacgggaatctgataaacagttcccaagtccaacatagaaattaaaacttaaaactgagcaagaatataaggcctgtacgaataagctatgttcacagaatgaccaagaaacgtctagaaaacttatgaaaattaactcctttttaaccactacttcccttatgccaccattttctataacacatgttcatataagcatttaacaaaatgtactttgtctgaacttgcctaatgactagaataagttccctgaatttttaagggatggcagaaatattgattatttggcaattgcctcagcccaagttccctggaaaacagaacttcagaattttaaatgatgatgctttattttggaagtacaaaaccagggcaactggatggagggaaaatggaagtttagcaagaaagaatgtgaagcaataccacaacatattactgtgtttgctacttcttcatgtggaccacaaaaagcacagcaattaagagatgtgttcgctaaccatgaagaacttctccaaatgagctgtatggagaaaacacgcttcaaaaccattcatgtatgaagaaaatgtgcttcaaaaccactcatggaaagaagcaagaaagatgttgctgtagaactcttttctgtctcctgttctccagtgaccaaagttcgccatattatgaattaattcccccgcgcttccaagttgaatgaagtgtctccttcgatgaccatgtgggatgccagataccacattcttcagggctgtgtcactgaagtccagaagtggtagaagtcacaaattctgagctgctggacctggctgggtagaggtgaacctggcactcctaagacaagtgcccatcagctctcaagggtggaagtattatctaagaagcagataaagctaatgtaagctgacccattattccgtaatatttgtgtaacttttaggaaatcaactttagcttagctgaacagaatatctaaagtcaaggctgctaacaaagaactatctcttttaaggtacaacaccacctagggtgtgggatatggaggaaaaagaaatacaccacacacacatacagtacacatataaaatatatgcatatatgtatattatgtaaaattgcctttgatattacaaaatattcagttctgcatattataatctaatcacaatcaatagatgtacaaagatgtaattttctctgcaaattagatgtggtttttcagagccagcgttcccatcactggtagaccagtgcaggccaaccctgacacagcagggaaaagaatgggaaagacattaggaaggaatagaatattaggcaactccacacaggccaaagtccaggaggcaggtaggttgtgtcagagagtgaagagaaggatgtccctgttggtgagaagagcacagtatccagagcatctgtcagtgggtaataagtggttgttcaggaatgcaaacaatttttgtactaggcatagtctaagtattttagtgtgaaggattccagtatgagtttattctaatggaacctataaaccaaatagaggaggacaaatgtccatatatgagaaatggacagagattggtctgaaagaaccaagcaggagctaatagacaaaaggatacccacatggtgattcagtgttaagtcttacagctttacaagctccctgtgtggagatagtaggggtcccaaagcctaagaaagagctcagtattggctgaatgttccatcttgggaggatcagagggctttgggggcaaggagtcagattaaagggacagatgcatcatttaattactaagtttcctgaattggagtgcattaacagttatatcctttcagcaaaaaatgtattaagcacttattatatctgatatctaatacatattttgcattaacaactaataaaaattctatactctcgtatattttgatagtctaacatatttatcttcatcatggattatgggtcatatatatgtatatatatatatataatatcatttcaaatagtaaattgtaatatgagtactatttgcatttgtctgacaatgatatacctaccttctttttttatatatacctaccttcttgactattgtatagtataatttatacttgttgtttcacattcagatttatctctaatcctttctttcttcttttccataacccctcaactataatgcaatcaattccttaaatcatgggtgataggaacaatgtatagtgattccaagccatttcctcaaatttataaattgagtgccaagttgaaaataatatcaggtatctacatttccatttaaatgttctcaaaggtggccattcctgacaactggcaagagtatcctgctctgacagtctgacccttacactcccattaaatataaaaacagatctgaatctttcacccagttgtactgtcaaggctagtgtaacttgcctgtcatataaagctctttgaatcagcctgccaagaaaatatgattgtagtacaaattttagcattcagaaatattcactcccctttcacttacatggattttgagggtcaaaactatgcatttttatcaggtgttttattatctttcaacttttgtgaagatcaatgtgttagaataaagaacttttttctcctttaatgccaaagtgatttggtataagggaaatactaatgagccattatattacttattgaaagttcccatttgacaaaatgagaaagttttatgtaaaggatggatgcaatctttaaattccataatgcttttggaaactaagcacctggtcaaaatagatgagcacttagaaaagggataaaaaatatggaactttgaattttcttagaaacctgatgcttcttcagcaaaaacagaaactaaaacttctgacataaatgtagcacagagagaaactttttccccattcattttaaatataattgtgcttattataatgcctaatgatgatggatgtttgcatttttctgttatataacagtactgcaattcaatcactatttctcttattatcatcataccagcgtaaccactggtacttttagcaggtagcatgtaggtcattctggcttcaacccatggattcattgaatcacttttatttatttattttttttacaggttagattgtaaactccatcatttaacagaatgaactattaaaatgtctaggatgttatcttaaaacaaacaaaaatcataaataaagaaacccaacttgaacagagttagactattgaccccattttatcatcaatagcatgaacacccactgtactaaatgtaagaagtctccgtttccttaaattatacaagttaatattttctttttaagagatactcagggaagggagggtgagatcattttagggctcatgagaaagaaagattgacagcactggctgaagtcaggcagaaagcagtcagccctcgggaagcatttctgacagctacgctaatgcactacagagctgacgtgaaacttcctctagattcctaaaagaagccatttgggaagagcctgttgataatgcaaaactgggccaaacggttctggttgtggactgctagcaaaagtctacccaagactaacgggaaatgactgacctcatgtttcaaatgaaaaatatgagtatagctatcctcaaatgaaaggagctttcccacaaattaggatgttatttttaaaaacagcatattggatttaacatctcaggtattttcctacaagtaggtagtttttttcttcttgaattctcagggctctgcttaaagttcaattttgtttaccagaaaagtataagaacaagtttaatgctgtaaaagttgtttacttagagcaataatatgacaaacagaactgaataaatagcaacttacacatcatataaagttttccagccaacattggctgtaaaatcaccagtgaactagaaaacaaaacaaaatacaaaaatcaggctgaaggatatagatgaaaaccaccttatcaaaagcacaatcacatatattatcttgttttgtgcctcaataatggatgaagttcatggtaacagtaactgctgtttttgattccttgaattggttcagcaacttgaccttgggtccatttaacattgagcacatgtgaagtcctttgccctgagcaaatttgttttcagggggaaaaaagtaaaaattgttcgtatagaatttcataactgagagcactaaaaaacaacctttctgagtgaaatttctttctttctcattcccagtacatatatatatatgtgagaaagcaaaatgaacaaaacaaaacaaaaacaaaagttgaatacttttccttcttgcccttcaggtaaactacttacactagaatttttaatatagactaaattatataaaacatatgaattaaataggaaaaagtggattgctttttaaatatggcattattaattttaaatatctatagaaaatctttctagtctaattagcaagtccttagaggatgtgatgattaattttatgtgtaaacttgactggcctaagggatgcctggacatctggtaaaacattatttctgggtgcaaccatgaggatgttgcaggaagaaattagcatttgaatcagcagacagcaaagaagatctgccctcatcaacatgggtgatgggtgggtatcacccaatccattgagaccttggatagaacaaaaaggcagaggaacggtgaattctctttctcttctggacctgggatatccatcttttcctcctcagacaacagagctcctgattctcaggccttcaaactctgactgaattgtaccatcagctttcctggttttccctcttgccgatgacctatcatgggacttctaggcctccataattatgtgagccatttctcataataaatatcctcatatatctgtccatatcctattggttctctttctctgaagaacttgactgatacagagtattttccctaatacataaatttaaagtgaatgtaaatggtgcttctatagtatgtgatggtcttcaaaaagacaatttttctaaatttttttattatgttccttgtaatttttacatgactaactttgactctctatttagattatttaaagcagagtaaatggcatcccgtttttatctgtaatatgggaaatattaaatcatgactgaaatagatatatttaatgtataaaaatgtggtgtcatgtgaatattacagaattatgaagtaatgttactaactttctagacatggcaagattttcttatctactctcctattttccttctatttccccttcagcaatccacagagcagccaaagtgatgtaaaataaaaataacaaaaccaaacaaaaatgaaaattttatcatccccttgcttaaagcctttcaatggtgttccattgccacaaaagaaggtccaaatgtatttaatgcccaaggaatctcttcatgatctctcccctgcttacttctctagcctcatctctccccctcctttatctcacctcttttctccaattgaactcaacttctctcagtatctctaaatcttacattctcctctctacctggattagtcttccctcccacatttcccatcccctcctctctcacacctctttcattcatctaactctattcatctttcataaggttccagcctagtcttcattttctctggaaggctctcctgactctccactatcatggcgcctctcacatttcatggcgcctctcacatctcatggcatcatttagaaaaacctgttacatgattagcactgttgtgattgtacactacatctctaacattcatttaaccaatattaattgagcacttattatgcttgggctcatttctaagcactgagaaaacatcaaagaaccaagcaaacagtctctgcctcagggaatttataatctgtacacacactgaatatttggcagcaagaactgagtgaaagaaaacaggacagtagagaacaaaagaaaaagaacagatcaagaagcgtatagattaaaataagaaaaagccaagagacattcaagataaaaatggaaagggctcttagaaatctggattgaccttttaaaagacctcactccacaattggataagccctcttttattttaaatcatcttttgccactggcttgtgatatcatttgaagatgatataaattatttgtcgcttctttctacttgcagccaagtacatccagattctgtcatgttatgccacgcagtgctccagtgatgtcctccaagagccatctgctgtccacaatgaacaaggcttcagaacccaaatgatatacttaaacctgagcaaaacaagctggaagcttgtttaaaaaggcattgctttgccaaaatgtattcactggaaaaatctgctataaaacagtgaatatattatgcaagtaaaattagacctttcaacctgcttggtatgatgcatgattgcacacatttactgtagttgattctgccagatttaaagtgattttattctttttatgagacatttagtgcaaaaggtcaaaagagagatttaggatccctgtcatccttttattttaggaaaaaaaacactcatttacaccactttggatcacaagatacaaatctttaagccacaacaaacaaaggacaataacaaacaaaaaagaaatcaaaccaaattttgtataattttgcacataaaaaagtgacagatgcaacccaaattataaaattctgttttgtaggaatgcgtttctagtgatggtaacattgtgaaatctcactgcctgctattccagttgtctaaccaagtcttcgctgtcatggctattgctgctgtctccaacttcacaatcatcagtttttcttagactcttagtggcagcaatttcagacaacttgcaatttcttggacatgagacgctgtgtcgcccttctgtgcctcttactgtgaactttgttttctctgaaggggtgtcctagtctttttgtcttactagtcaaattctgacttttcttgtcagctctacctaaaagattacctctattctgaaggtttttgcctcctcacacagccatcccaaagaactgatccctcctttgttttgttgtttttttttttttgctgccaattgaatctggtacaaacttctgttagaccccttaccctctgtgctgttattatttatttatttatttacatcaatgtttctcttactgtaacatgagctccctgaggacaagaagcatgtcttccttgtgactctagcacctggcatgtgagatgtgttcaagaaactcaagactaagggaatgaatgaatgaatgccaccagtgaccttcagtgcctctctagtggtaccctttttaaattgaaaatttagactgagaaatccctgctttctttttttccttatcattaatcaaagtcataatgatgactaaaaaggaactgaaagtcaaaatgtgatttctacttatatagtatagttctgagactgtgcctttcattttacaccactttcctaattcatcccaagtcatcctcccagcaaataatcaataaatttacattataatcatagcaccatactaaatactgtgaagtagcatttagtaaaaagaagaatgaaagatcctccaaaactcttataaactttctgggaggacagtacattcaccttttaaaaattcaaataatagtacgtagaggttacatgatgctaggtgcaaaatgagtgaggcagacagtaagtgttataggcaggcataagaggaataatcactttgatcataaaccagtaaggatctgaaagttccattggttttagaaatgagaaaagttgaaaatacagcatattgtgttggaataatggaatgaagaataaaggtttgtataaattttctcaactatgaacctgaggatgagtagactgtcttccattttttaatcaatttaccccagctttaaaacctacttaaaatataatatgatttggctatatgtccccacccaaatccacctccaattgttatccccacacgtcgagggagggacctggtgggaggtgattggatcatgggaccagtttcccccatgttgttctcatgatagtgagtgagttctcatgagatctgatggtttaaaagtgtttggcagttcctctctctctctcctgccaccatgtaagatgtgccttgctttctcttctccttctgccatgattgtaagttgcctgaggcctcctcagccatgtagaactgtaagtcaattaaacctcttttgtttttacccagtctgaggtagttctttatagcagaatgaaaatggactaatacagaaaattggtgccaagagtggggtactgctataaagatacctaaaaatgtgaaagcaactttggaactgaataatgggcagaggttggaacattttggagggctcagaaggagacagaaagatgtgggaaagtttggaacttcctcaagacttgttgaatggttttgaccaaaatgctgatagtgatatggacaatgatatccaagcttaggtggtctcagatggagatgaggaacttattgggaactgaagtcacttgctatgttttagcaaagagaccactgacattttgcccctaccctagagatctgtgaaactttgaacttgagagagatgatttagggtacctggcagaagaaatttctaagcagcagagaattaaagatgtgacctggctttttctgaacaaatacagttatatgtgtacacaaagagatggtctgaaattggaacttatgtttaaaagggaagcagagtgtaaaagtttggaaaatttgaagcctgaccttttggtagaaaagaaaatcccattttgggggaagaaattcaagctaccagctgcagaaatgtgcttaagtaaagagaggtcaaatgttaatcgccaagacaatggggaaaatgtctccagggcatttcagagatcttcatggcagttcttcccaacacaggcctggaggcctaggagtgaaaagtggtttcattggctgggcccagggccccactgctctgtacagcctgaggacttggtgcccagtgtcccagctgtgccagctccagtcatggctaaaagaggccaaggtacagctcgggccattgcttcagagggtgcaagcgtcaggccttggtggcttccatgtgatattgggcctgcaggtgtgcagaagacaagaattgagctttgggggcatctacctagatttcagaggatgtatggaaatgcctggatgtccaggcagaagtctgttgcaggagcagagccttcatggagaacctctactagtgcaatgtagagggaaaatgtggggttggagcccccacccatagtccctactggggcactgcctggtggagctgtgagaagagggacactatcctcaagaccccagagtgttacatacacctggccccatgcaagtcaaaaaaaaaaaaaaaagccacaggcactcaacgccagcctgtgaaagcagccaatggggctgtaccctgcagagtcacaggggcagagctgccaaaggccttgggagcccacttcttgcatcagtgtggcctggatgtgagacatggagtcaaaggagattattttggaactttaaatttaatgactgccctgttgggtttcagacttgcatggggcctgtggcccctttgttttggctaatttctcccattcagaactggaagatttactcaatgcctgtacctccattgtatcttggaagtaactagcttgtttttgattttataggttcataggtggaagggacttgctgtcccagatgagactttggatttggacttttcagttaatgctggaatgagttacaacttcgagtgactattgggaaggcatggttgcttttgaaatgtgaaaaggacatgagatttgggaggggccagggtggattgatatggtttggctctgtgtccacatatgaatttcatctcaaattgtaatccccacatgtcaagggagggatttggtgggaggtgattggatcttgggggcagtctccccccatgcttcacttcttgtgatagtgagttctcatgaaatatgatggtttaaaagtatttggcagatgctccctcactcttactctcttctgccaccatgtaagacatgccttgcttccccctcacctaccgctataattgttaagtttcctgaggcctttccagccatgtggaactgtgagtcaattcaaccccttttgtttataaattacccagtctgaagtagttctttatagcaatgtgaaaacagactaatacagaaaatatgagcattttaataattctttcagcgaaagtctacctttaaaatagatttatttgtattaaacatattttggtatttccagctctaggtacttccagacatttttccaagttcttctccacctttgggggtgagcccttcagccccatcctttccctagagtgatgttcttcagtctttcagatgactgtgccctctttcctattgagtgtacttctgactgagtagctgaccccaaacagactgcctctaaagatgtcattcttcatcttttctctcctcctcagatgatagtcagagctagcctttctgacaatggtaatttaaggtcactgttccattctaaaccaatatatcacaacactacatgcaatagctgcaaaagaagacctgctgctcagatatgttccaagcactgtggatctgtcaggaacagtctaacttaatgtataaagagcctgtgggcataacaatggcacaggaagcaactgagctctgcactaacacttcctgtctgtttccttagacagaagtgaaggttgttccctctgttttaattcactggggtattacatatattaaaaaatcatagaatattagaccttcatatgaactacaagatacaagtccagttccctctatttacagaaaaatctgtaacttgcctaagatcacaaaacagattagagaagaaagagggccaagaagccaggattcagctctactgttgttttgtctctctacattgcatgctgcttgtccaaaacaagcaccccaggatttatgagaatcacccttgtgtatactttggagtactattcaagttttccattctttttggatatttgtttttaagcagagtttgcaaatactactagtataaatataggtatgcttcactttatgtaatttattttcctaatgacaggatctaaatcttttcctcaaataattatcatccaaccatggatagagatagatggtgtatcagtcagcgatatggtttggctgtgtctccacccaatattcatcatgaattcccacgtgttgtgggagggagctggtggaaggtggttgaatcgtgggagtaagtctttcccgtgctgttcttgtgatggtgaattggcttcacaagatctgatggttttaaaaatgggagtttcccttcacaagctctctctctgtctctttagctgctgccatccatgtaagacgtaacttgctcctccttgccttccaccatgattgtgaggcctccccagccatgtggaaccatgagtccactaaacctctttcttttgtaaattgcccagtctcgggtatgtctttatcagaagcaagaaaatggactaatacagtcaggattctccagagaaacagaaccattaggatatatatatatatataattattgggaattcattcccgtgattatggaggctgaaaagtcccaggatacgccatctgcaagctggagaaccaggaaagatgatgatataatgcagttttaacccaaaggctaagaaaagggcaggggcaggggagaacttgtataggtcccaaagtccaaaggtctaagaacctagagttctgatgttcaagagcagcagaagatggatgtcccagctccagaagagaaagcaaactcactcttcctccactcttttgttctatctgggccctcagtagattggatgatacctgtcctcaaggaaagcttctgtacttaatctactgattcaaatgctaatgttttcctccagaaacactctcacaaccacactagaaataatgttttaccagctatctggtcatccctcaggccagtcaagttgacacataaaattaatcatcacagatgctacagggattaatcattgctttgtattagtattattctcacagtgcaacctgataagaaagcaaagtacccactctttaatgttacacatcaaattgataccactgatataaaaatgctttataaaactgtcaaatgttatatatctgaagagttatattttcattaaaaatttaatgtattaaatatctcaatattaacaattgccaatggcctggaataattaatctttcactcccctttatgatttatgttgtacattttttaaaaataaaatccattacttttgtgttaatttccatagttctttgcaataaatactacaaataagaaactttaaaaatcattatttaaaatacactggggagggtaggctggggtaggtagtcttctgtacagctgggtttaaaaaagtgagagagagaatacctcaagagagatgttagagaagagtactgctatccagataagagtgggaatagtatttcttaactcattttaacatattatcagctatccccctgagtctttaccatgcagtatgttttcaaaaccataagaagtgataggttgttttgaaaaaattgcctgtactgtcagtagtgtttaagttatctaaactcagatacaatggcagttctcataataaagtacatatttattctcccacactaaagtagcattgtgtcctacattatctaccttataggatgaaatagaaaatccacttttacagatgtcccccagaatagtgttactcacttaatgatgtagcacctatgttctcagtgaaagagaatactgagaaatagatggcaatgaattattttcaggagcaatttaagaggaagcaggtgaaaaggatcctaattcttcagggtttgaatagcacgataagcagtgttttattacaggaacaacaaaaaattagcattcactgagctgcttatacatttaaacaatgaataaaaatgtagtgtagttctaagtattgcaaatgaggagaggaggaggagagtctttccatagttaagaatttttttagcaagtagaaaacaaagctgatgatttagctattcatgtttatttgaaattgtttctcatctgcccctattctctatgaaaaatacactgtaaaacaaatttcaaaaggagataattgtgtatttcataatcagatggaagcgtaggcttagagttagggtgggggagggatagggcagcaacaccgacagggccaggaagataatggaaataggtcaagtgtgtctgatgaaagacttggtgagagggtggagcagacgctctagagagcccatgccctgtctaaagacatttagtttcagtttaaggaaacaaaataaaaataacttagccatgaaaagcctaaattcagacctttttcaacccaaggaccaatagttggtgagctctgggttcatgaaatataaaaccctgagacctcagtgaacaccctcatgaagatcctcagcacacataatgaaaacctcaaacaagggagaaaaaatctcatataagattttttaaaaatttagtttcatatgtttgttacctaaaacaatgctgtttaccatcgatttctgcagtgcttatcagcttataaaaattggttattaagaaccaatattttaaaaatactgtgccaaaaaaaggttcttttgcttagggtaagagtgtttttaatctggcatctgtgaatcttgagacattgatacgaaattgtgtgcccctgcacaatcccatgtgcatgcatgcatgtctgtacacatatgactgtgtctacatgtgtatttcaaggacaagcgtttcatagcttacctagtgtgccatgacctcagaaagagaatagaaacacacaggaaaagcaagcaatccagacacaatccttatcaggctggtcaagctgcagacagaagtctggcctgccagcactcaaccataaatgatattatatgatgacagaattctacctgtgaaatattaagatgaatgcaatttgtctccagtcttggaagggcactgggaggacaatggcaggggtttaagcatgggactaaactcactggaccaagacacacagatttccttgaactgggcaagacaaggtctaaattactagaactgtgtcagagactgtccatcagcagaattgactttgcacctctgactcctaaaatctgctgtttgagaagatcatccctaagcctgggcatggtaggggtgagttcagtgattccacatgaaggaattgagatgctgatctgggctggaagccaaatgagtccaaaaaaagacaaactttggatacataattaaggaaacagataacatttactgagtgtacactgggtgctggctgctaagaggtgctttatgtgtaccatctcatttaatccacttaacaaatgttatgctagaagccaaaatatgagaagtttctcctttgtagctataaatgaattcattccactattagccttcaaactttcttcaagtaaagacagatattatttccatatttcagaaaaggacaaaactttccagagtaccaaagtttccctaaatttgtaaatctcaataaaggaggaatacacatgcctctctgaaagaggctgggcacatagttttaaaacacatgcacaatataatatcgttttacactataaaataatttgttgatttgggaatacaaactaggaagtgatgcacgagagatggatttctttctcaagatcagtgattctcaagagtaagaggactatccccctagttagggttgtctgttctaactagtgaatttgagatcattctgtgacttgctgtgactttttgggacaccatagtgaattaaggcagaaggccccagaatgctgacctctccacaaaagctgctgaaacgagaccacctctgccacacataatcccaccaacaagaaattataacttaaagtcatcctccagtaagcacattaatgccttctttgtctgacatcagtaagactccatatgataagctttccaaataaccaatggttacccattaagagttaaaaaataaaaagaaagaaaaagtcaaaccttggtttcaaacctttccaatatatattattcatgctgttgtcttcttaaacaaagtgtttaagttactttccctcttgcttaccactcacgatcaccactgtaaccatgaattattggccagggatgtaacctaaagtgtgcttgcctccttttctgtctgccatcaggctgtctgctcacacggtcttggtacccactcgtatggcctatctctttacaatttaatgagagctgagaaattgtgggcaaatgtcaaaactcattatagtttactattttatggtcattaattcaaatcccttcattttgcagttctgaaatctaagactccgaggattaagccttgcccaaggtcacacagtgaactatagtaaagttgcatcttacaatttgtatttcagaaagaaaaatattgtttagtcaaaattgctcttaaggattttttaaattatgctttagtataatatatactcattaattgagtactatagagatagattgagaacagagcaaaagtctacagacagattactgtctattcaaaccgttcaccttcaagataaccatcaaatctagtaaatgagaaacagagagagacattttaagtgttcttgcttctctacagaatttttccatttggttccagtattaagcctctgtatccttactacatttcaattgattggtctctcctctgcagattagaggcttatatagtaatactcaggtgttaaatgcacctataatacaactccactctggggatatagggcagacaaagatacacaaatatacagtacttcttgttccctcattagcactttttcagctacaactacctacctatttatcagacaacaatctctgaatatgacttggaaaacaaaaacacaaaagttttactaataaacattttagtacccctccagtttacttatttcctgtttttcttttgttccctaagttattaagtttgctctgtaagagaagtattagtaaatgagaagccatttgagttacattcagtcactttgattagcatctttggtaatttttttctctctcataaacatatggtaaagcaacatgtaatgttccaataattgtgatttcaaatctaaagtactatttgttcattcccgaaacctgaagcaaacatctggtggttaatgctttaagaaaaaaagtaccttagtgcattacctctgtatatgattcaagatcatgggcaaaaatatgtagatgagatcaagccacaaaagtttaagttgatccattcaattaaaaaaggaaaaagaaaagatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcccgggcgacagagcgagactccgtctcaaaaaaaaaaaaaaaaaaaaaaaagaaaagacccaggtgcttctgtgtttcctctaatgtaaggaacggagactatgcagtgcctgaaggacttcttcctttctgcctcatcttgcaattagatataaactgtatcccgtatatatcctcccattggaacaaaagatgtgactgcttccctatccctattccatgtatgctcagaattattccagtttgtgcataccatcaggttcatattatcatgcattttgttaattcaaattctatttcctacattaaacttatgtcccattttttcttgttttattttaagatttattccagttcatactttccatttaaagacagcagttgttggccaggtgtggtgggcctgtaatcccagcactttgggaggccaaggtgggtggatcacttgaggtcaggagttcaatatggaccatcaccatgttggtcagcctggccgacatggtgaaaccctgtctctactaaaatacaaaaaaattagctgggcgtggtggcaggtgactgtaatcccagctactcgggaggctgaggcaggagaatttcttgaacccaggaggcagaagttgctgtgagccaggatcgcgccattgcactccagcctgggcaacaagagtgaaactccatctcaaaaaaaaaaaaaaaaaaagacaacagttgaaataaaattggaaataaagttgcactgtccattttgtaatgttgttcattttaacaaagtgttttgaaaaaaaaaattttatagtggtagtgtattagtctgctagggctgccataacaaaacaccacagactgggtggtttaaacaataggaatttatttctcacagttctagaggctggaagtccaagatcaaggtgctgacagcttggcttctcctaaggccccactctgtggcttacagatggcttcttcttgaggatggcctcaaatggctttttctctgtgcctgcatgcctctgataccttttcatcttcttataaggaaagaacaaagtcatattagatgagggccatacccttataattttatttgaccttaattacttctttaaagaccctatctcaaaatatagtcacagtgggggttaaggcttcaatgtatgaattttaggggaacacaattgagttcataacagggagcaatgccattaatcaaatattctgtaataccttccccttacagaaaaaaataaaaccgtatgaaggaaagtgataacgttgtcacttatatgtgatatcaaattattcaaaatataaatttatatgtgaataatttatatgaaatatcatttataggtgaatgagtaaatgaacataaaataaccattaactctgctttttgacctatcttaatagaacccacaaagatttagcaaaggaacagccaggcaggctagcaagtcacactcttacatattgttttctggaacaaagaaagatccagcatgagaaatgccagatgggactgctgcccttgcccttgtatatgttctcgggtcaaattgacaaatttggactttgttctctggaaatgtggcttccatattggaaacaaacctgaatcttacttaaatagctcaatatgcagagccacaagactgaggcactttagtcacaaacatacaataaaacaagaatactctagtattggtgcacaaatacaagtagaggtatccttacccccttgtgaagatcacacccattttttagaacatgactttatgtccaattggatcacttgcagtgttctcatttctgaatttttttagtgctttggattagggtagatagatttagtaaataaaaatatagagtgcccagttaagtttgaattgcagataaacaatgatttggttttttttaagtataaatatgtctcatataatatttgggatgtacttataccaaaaaattcccttgtggaacatacttataatgaaaaattatttgttatttaactgaaatacaaatttaaccatgagtcccttattttatctggctaccctactttgggttcaagaatgaattttctccccttgcaactccctgccccccaacactcttaagctactgtcaccaactttgtaaatttaattccctagtcttaatttggtgctgcctttaacctctgccccaatgcatgaaaacctcgggcttcaggcttccttctattgggctgctttgatatgtggttacagaatccctgtgcttaagtattacatctttacatcatatgacagcattaatatacataaggtactcaataatatggtgagaaatttctaaaccttgaaatttccaagccctgggctcagtttgctcacttataaaatcaagggagtggattcaaggtgttttccccaaggtttcttctaacaattccatgctactagtctttgaaatgagtgttccattaatgctctcatttgccttgtaaaacctaaattgttcccattttggatgaatcccgccccgacccccctatacagagagcaagagaagtaacgtaggcaagcgacgcgactaacggaagtgttcccccccgcgccactagttcgaagcacccgattgagcacgcgcccgacgggactatagagacgccgacccgcggagcgtgcccgtcccatcagacggctcccnnnnnnnnnnnnnnnnnnnnnnnnnnnnnnnnnnnnnnnnnnnnnnnnnnttgtatatacatttgtaatttgtcccttttctaacgaatgtttgggtgatttaagggggaagtaatgagtagtaatgaggaacaatgttagagagagtatgaagtagcgtggaggaataaagaggaggaagggcggctaagaatgtagtgctgtaggttagttaggaggttgcggttataataatcaagttgtaagagggtcaattctgtaggtacgctgaatcatgttggtgaggaagggagagatgcccccccccaccccccccgccgcggtaagtagtgtttagattactcaattaatagtttcacctttaaagatatttaacttaaattccttaagggccaaagaacacacttttctttccacccctacttgcaccaggctttgcacacagtgggtgatcagattatgtgatcatgatcatggacaatgttgaaacaatccctttgtggtgagctctgactgtcaaaaataatttttgttatgaacctaagccacctccacggtttaagacagcaatctgggagccgctcattgttctcttccgccatctagtggcgctagggctgctttcgtcccttcaactcgcactttggagctgcagggattttaaaattgtaaatcaaatggatgaattgttttattcttgtcattacagtaaaaagggatttatagagtgtttcaagagataaaaggtaataaatgttaataaaatttaagtgtaatacaatggcagactttaattcttgaacctttaaattcatacaatttaattcctttaatatgttaaaatgttaagttgaaattgaagaataaaaatataaactatattaaagtttttgaaagaaagattatcctttcaaggtgcgcttatatactggttaagaatgttttcatataaaataaatgtaatcatagcagatgtaaagcaaacaaagggaacaaataaaattctggtaagtattgaattggtagagaatgtttccgttctgtatttaagcacttgtcttcaattaagttagagattattctcattattatttataaatgcaatacaatgtttaatgagtgttgaacgatatttagttttaatgtcctataatctggaactttcttcaaatggcattatagaggggttaattgtgtgaatctaaagtaaaaataaatttctctaatgaatgaaataaaatatttctgaagtgtgacttatttcccattaaagctatttttactgaataattataggaaatgtttctgacattttaacattattctggctttcttttgattttaatttaaaatgccagtgctattatgaagtatttagatctttctaataaaaaatatttaattggaataccattttgtttttaatacaacgataagccagctaagaaatctccaatttgttttccagggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtaagtgctaccgatagttaaactgccattttgtgaatgtaaacacattagcttgagggggaattatgccttttgtcctcactcagattggcctttatcttcctgagaacttctcatggtctatggctgagtttgagaagctgagtaacctttcactctgagctgtatttgatgtcctcagggacagctgccaggctgtgccatgtgagtgcctgatgcacatgttacatctcagatttccatgcttgttctaatgaagtctgactgtgtttgtgcaatagccttgacctacaagtaagacaaaagaaagagtaatgtttacttttcgtttcttccttagggcaattcaatgcagcactgtaaagagcaaatcaatttagactagatatcacttagagggaaaaaagtgaatgctttcaggcaatgcattatcaatatgtgccatctagtacggttcttttgatatgcatgacccctaatgcaaactgttttgtttctattttatctataaaactaccttggtggttgatactataatattatagaacaggagaattcacacattgaacccctgtgacctatccacagtgatagagacagtattcagaagatgcagatactctgacaatgcaaataagtgtgctgtcagagctgacattatattttaagttcccacttcctcatctcgaaattcaggctttgtctactcacctgttcttctcaaactataagatggtttctgatacaatggtaataagaaatcacctataatgtgattctgaatgttcataggtgaaaacaaaggctacgtaactatagataatccctaaacactattgccacatctcatttatttttgccagttttaacacaacttaagcaacccacacacacctccacacctcatactatcccaatctcaagttgtccaagtatcttaaggacttaatcacagagaaaatttatccttttctaatgtcaggcatagataagattggattttggttggctggcaatggctagtgtttctccctgccatacagtactgcttttgaagctgactccttagtactgtgggtgtctactgactctgtggaaaatgctaggtccagaagttaacgtagcagcaggtttgaggccaaacacactgctcagtcattgttctccaaagcacaacatcaaactgcaaagccagtgtggctgggccctacagagcatttggccttaaggacaaagtgcatcgtaaccagcaacctttgctccacccccgcaacacttagactttttggatctgggccatttgcctacagtctgctattcatcagggaatcatatttgaaggactcctttgctcttccctgccattgggctttgtttggggcagttcctggctgcttttccagtttttcctaaaactgaattccagaggcataaatttgttccttcactttcaaaaggaacccatatttggggattttgtttgtttgtttgttttaaccagttaccttaggtagtaaaagccctggtttcagtcaccataattcctcttctgccctaaactcaagataatgcttgcctgcttgtcctattttaacacaaccaaaataggccattcaagcaaatgcccagaataaaaagtccttctcctccagatgagttatagtcttcactgcacagaagagtcttcaagtaccctccctaattggtattctatttggttcttgtcttaaccagttcccagcagacttaaatcagagggcccaaaactttactaatatactggtatcagtaagaagttcttgagcatccatagatggcatatgtatatttatttgcagattatatacaagtactactgtactaatatattcatttaaaactatttagtgaatgccttctccattctaggaactaggctttcaccagagaacacatattacatttggaagggactgtaaagattatactaggccaatccctttattggtcatgaaactgaggcatagagaagtgacatatttccttaaactctcatagtggtgacttattaatgctcttagaaaataattccaataaacttctagactaggtcatgggcaaggagaagaggaataattgtatctttcatggtggttttgtttacagtccatgtagctcctcacgtagggccagtggtttcttgccctcatggagcttactttctaatgggagggagatagactataaacaaaatcgataagagacatagtatataacatgataatcactgctatgggggaaaaaagcaagagaagaggataagagatattgggttgttgatttaaatatatatatatattgcaaaatatattcataaaagtcatttatggtcataaaagtaataatcattctaattagacattcataaataatcattcttataataggaggatacaaataaatataaaaagcagttccatgatttttcctgccccccagattatggcaccacccatttagtaaccatggccacagttatgtggactataactcaaccatgaaagacacttaactttaaaagtgcctcactttcaataagtacaagaaaggggtgagatgatttttaatatccactttaacagtaacatgctatgattttataatctctgaagaaatatttattatatttttctcagcaaatggaataaggaatgattcataatattcttttctgatgtttaggacttttctgaatctctgcagaggtgccaagaattagataggatgtccacagagcagaaggacaaatgaagatgccagaccacaagacagattttttaggagagcagcttttgcccaaatgtgtagttttcaacatagtccaccatgtaaattgttcttaataattgtagcctaaagcagtccaaaccctgttgtccatcatcttttcctggatcttgcccaaaaggttgcccagccattctggccatgtatattggtgatctgtgtccaagacgaccatttagagagtgatttttgtctattaaacctcatttggccacagaggctctatctggaacctggagaagatgctgcagccaggaatagagttccaacattaagctcattctcattcgttcaggattgccaatgctcacagcacaaggctgaactcttcctccacccagagcttgattgtttttccactaggtagggtttaagctgttgtattgtcatggtcttgacgtgcattaccaaagaatattcaagcaagaatctgggaaaaggggaaaaaagaggatggaggcctggggggtgaaaaaaaacccaaaccttgaggtcctcacatcaattcaagactacaggaaaatagtaggagctaaaatcttttatgtatcttgtgaatatttttgctgctgcagtaaagagagttgaaattctgtttagcttcacatattggaagtcagcataactgtgacagatcctataaccaggattttgtttggaagcagaaatagcttaatcaaaaacttcccagctgctctttccaaatactggctattccctatctgtcctgcatttctcatttatttgatcaaaatacagtattacatttgacttttaccaagcaaggcctcttttaaatgaaaatgtgatagacaatacaaatttgactatgttctgtgagaatattttatatttttactacaatttggtgagtttaacaaggctattcatacagatcaaatggaatgttaccatgttttatgattttaaattagtttaagaaatttcagattgtttttatgagtttctccgttctgcagactgttgtatattttattacaatgaacaattctgaatctgcagaatctgttttagtgaataatataatgagtttcccaaaggtcagtggtattatactttagggaaaggaaatgagaaaaaaagagtacacagaactagtccataaaagacctaacaaaatataatagcaggtaccatctgcttagccattcagcagttaagcatgcgccagtcattagaccaaatgtgtatgtggggtggggatggggaattagaaaatccagttctcagtaggccaagcatagtagctcacacatataatcaatgctttgggaggctgaggcaggaagatcacttcccaggagttccagaccaatgtggggaatatagcgagaccttgtctctacaaaatatagaaaaaattagctgggtgtggtggcgcacacctacagtcacagttactcagaaggcttgagcccaagagttccaggtgacagtgagccatgatgatgtgtcactgtactccagcctggtgacagagtgaagtccggtatcttttttttttaagggaaataaagtaaaagaaaatgcagttttcactctcaaagaacccactatgtaggtaatgagataaaattctggtatttttaagtgttatccccacccccaaatagaatgtagactcatcaagggtagattctgtgccttctacttgttttttaaatggaaacaatactgtgtgaaaacacagttattgtttaataaatatatatgccaagaaagcttgcagaccctatttttcagggttcttttgattacaaatgaaagaaatgtaacccaaagtaacataagcaaaaattaggaaattttttcatcatgaaactaagaaggtggtccagcattgctcaatccagaggctcgtgcaggatttttagtgcttcactaggtgcattgacctcattctctcctactgctaagttcttcgctgtctgcttctttacattccagggctcagtattccagctttgcaaccccagcaaaacgagaccttctttctgtgcaaattcgtacacaaatcccagaggagattctggctggctttgttaggaccttgcccaacactaaacaaaaaccatgccagggaaatggacactatgattgacccagctaggtttatatgccagtctgtgcacttagaggtggtcagagcattgtaactggcagtttccccataattacctcgagtgagggaggaattccccaaagcaatgcagttgtgctatcagaaggtgtatattacttttttggtatatatcgttttcaagagcaactttatttactgcagtatcaaataacagcaaaatattaacattgtgcatcactgtattctaatgaggcagcagatgttattgaaaagaccagtcgggctttagaacaagatctctcaaccttagcactattgacatttggggccaaaaaattctttgcagataaatatgttacatgctttgcagcacattcagcagcatactcagccactaagaagcagatgccagtaaaaccctcccacactgtgacaaccaaaaatatcccagatgttgtcccgtcatcaacataagatggaggggaaaatcacccccagttaagagccaccgctttctagctagaaagatctgggatcgaatcccagatccacaattcactagccatataatcttaggcaagttgtttaagctttctgagatactgggtatactgaggttcaaaatacccagctctggaatttgaaagaattagagataatatatgtaaagtacctggtacataggtgtttaatcaatggtaataatagcttacattttctggtcttactatgagccaagtattttatattattagctcatttaattttcaagattattttctgttgtaggtaaccattattattcccatttctagataagataactgaggcttataaagtacaagtagcttacccatggttacatagctggttactgataacaccaaagttcaggccccctgcttactcctaaatgcatgcttttacccgttaagctctactgtggaagtccaattttcaaaggagtcttcacaccacagttctacaaaatgagatcaaagcacatttaattatgcatgctcctctatcacaagagtagtatttttattgtttcctattcgcaaaataatgtggattgactcccagttgtttggaaatataaatattttctgcaggatttttgtcttgatgttaaaaatttataaaatgtaccataccgttactatatttcttaaaaatatttaaggcagtagcttaaaatcaaattttaaagattgacatatttagcctattgccagaaacatttcacaagtaccttgaaagtgtatagccccttgctgttttccagcgtatgaagatttttattcttttttataaggtatttcagggtaatgttttatgttattttcatccaagttcaaaatagttattatttactacataatggaagtgcattgtaatgctggaactacacatgctccaaagatgataccaagggcactgtggttcttccctccaacacttataccatgtaatgtagttaacagaagaaaatggaagcaaaacacgaacagcaggcaacattaaataaccaaatccccacagagctcatatgtggggaaaaaagtagcgacacttaaatgagaggtgacttagctcaagctaatgatctaaatgtaagattgcagtcttgggttttgttttgttttgtttctttcccctgacatgatgctgttaaaaaataaaaatcaccttgaagcactttgaagcccaaatgcctcctgggtatggtatcatttaggcatatgctagctagctaactagttcagtttcccaaaaagagaactgctatcagggagcatttcatttgaggtttactagaaaacaggatgcttccttggtgtttttgttttcatttatttttccctccttgcttttcaaatgcttttaaataataatgagttttgctttagattgttttctgaaactcacctgagggggaaaatatggagtttatcattagaattttatttttataggtgatgtggtcagaaacaaacttttgatcttagctgaattgatttgttttttccaaatttaagaaggaagaaaataaccttttactgtacttcctgtttgtcctcataattctataacctttctcaattatgggtcagtctttcagccaagaatagtggatatgtagaatccacttacctgaaatgcagcatgattttatgactcagagatcccagtcatttccaatttttgtctctgattagattttccaaactctactttattatgtaatggtccttgtgtaatgatctgtgtaagacactacagcaaattgctaaaagcccatttctattatttcaaccttccataatacagaggaatttttacatttatttgaatatgtattctaccaaaggaattttcaaaaaggccttcgttttcctaacttttcagtaattcttactgttggtaaataggctatcgcagtattttaattaaatacatactaattacatgagtatgatgtacatctgctacagaggcaagaataatagggaatattacaagatgtaatcaatcataattcaaataagtttcaaggagaagaaaccagtaaacaatacagtactaccacagtataacttttaagggaaaatttttttaactgaatgaccacaaaactggaaaatgtgtacatgccagcaatattttcataaaaaattaattatacctttaatttctatttggaagaaatatatttactagctttagaacttacttatgatttttattcattttcatgctctttggagcctttacaaagagagcattttcaaattccctttttctttgtagtcataatctatttttccatagcttttagatatttttagtggagccaggaaatgtattatttagagttgtctactatctttctaaaatcaaaatgatccaccagtgaagaaatctcatttttttcccagagagtgcttgggaaatggcactaagtcttaagaacatcagcttcttaaagaaaaaaaaatagtctcagaaaagtagatttggaatgtgtccttgtattttcaaaaatgtaatttgttgtccaggaactggcatagtaagaaataccatggtgccccaaatcttcctagctatactttacaaggatatactctggttctgtctgtatttttgtctcagtatagaggtccacctaagcacttggaactctgtgagaaatattccttagaatggaggccaaatccagaattaaatttacagaaactccagatctagagatgttaccaaagttcctacagactaaatctttggtttcaatgaccagaatcatagattttttgaggtgaaaggtactattgcagacagagtccagtcctctttcctttatcagtgaagagtcagagacttgcccaaaggcagagcttggttagtgacaacttaggacttcagtgcggtttcaggcaactccttctctaatgttgtttccatgacttacaaactgaatgagactttaaactgttagcaacaaagattttttaaatgataaatcatgtcatcaacaactttttaacatatgagagtcctacatgttgttcctcattttgtccactcatttaacaatccgtaaaaaggagacctcctgaaggaccaacattttctattttatataggtccttgacatgctattgtgacttccaaaaagaaaggatggagaattgtcttaggtgtaggattttaagaaagtttttttttaatcttaaagctaagaagaaaatcttaaaaagaaaatcttaggctaaataacaaattagtctctgaaaaaagtgttttctctgtctaaatatttcatcactgtaacgccttttttctataattctttttattagtatacctaatttcatttggcatttgattgcttttaattgagttatacattctgaatgttgaaaaatattgaatgagaaagtatattagtccattttcacactgctatgaagaaataaccagagactgggtaatttataaaggaaaaaggcttaatggactcacagttcctcatggctggggaggcctcacaatcatggtagaagacaaaaaggagtgaaggcatgtcttacgtggtggcaggcaagagaatatgtgcagggggactgccctttgtaaaaccatcagatctcatgggacttattcacgatcacgagaacagcacgggaaagacacacccccatgattcaattacctgccactgggttcctcccacgacatgtggggattgtcggagctacagtacaagatgagatttgggtggggacacggccaagccatatcagaaagtataaaattacaagtgttatttacttagaaccactttccttctgccttgttttttctttttcttttttttttgctcatgtagacacaatctttatattgcacaccaggaaaatacattaccagtgttttcagtgttattgtattatgaatataaatatcctaatctgtataaataatcgttaccacaaaaagtaagtatagactgtgactctctgctttgcaatcccccttctacctgaaattataggttttccacaaagatgtgaagaatatttagaaggaagataaaaataaaatcatttcacattccattttctagtgtacatttcagcccttgttaaattttgagacagtttctttttaaaagactgtataaataactaaattcaacgtgcctctcttttggagatacctagcagccttataacataaaaatgtgataccctgcagagtctaagcagtccttgctcaatagtattgttcagagatgtctcaatatcttcttattgactgtctaatacttgttttccttaatataagatgtgcattgccttctttgattcagaaaccatcaagaaaattggaaaactcatcagattcagcaagagcagaacagcctgctacgtgccccaactgagccttctgttgattctaggttgttaaaaattgtgatgtcaatgtcaagaaaccagtatgatctatttagaataagcagccaggtttaagataataatttctgacagaatgtaattccttctaacttttcataaaaattatcattgcagtcattttcatatttttcacattattttaattttcttcttacattataaccttgtataactcttcttccaaaggatgacagcctacaaatatcataaaaccaaactgttaaaaaattctctctagttaattatcaccccttcgtatcctaagacaacaaacctcaattagtcctttagacaaagcaccccatatgctgctccctgtcagtccttaattagggaatcagaatatacctctaagtcaaaactttccacaaagaaaatgtttatgaagataaaggttaatataggatttctcaagcttctctgaaaattcagctttcataaatcacatatctgacaattggcactccattctttgacttgacaaggcattgtgctacatgctgggaacacgtggaacaaagaaacagtcgctgctctggaggagctcagttcacccaagctaagagactacaaatgttttgtattggctggagccaagggtaaaacggaacacagcaaaggtgaggactgagagccaggcacatggtgagccattgcagaatttcagatgtgggaggaacatgatcacagttccacttcagtaggattgctttcattgcatcgtgggggatgattggtggaggaaaaggagaagcaaggagactaatggggggcctttgcagtgatcaaaatgggaaataaatcatttgaagacagaatgaaaaaagatttaaattttatgaaggcggtagaatcagcatgatgagttaattttgagcaacaggaaaggcagaggcccagatgactccctgaccgctaacttgaatcactggaagaatggcagtacccttcctaaaggacaaaaatcccaaaggaggagcgggtttagttttgcacaaaagaaatccaagatacctttatgaagtgatatatcctataggtgataaatatagaaatctggagagaaagctgagctagagctgcagacatggaggccataagcagataggtgatagtgaaagcacggagtatataagtcacacaaagagatctcaagatctaattctgggggaatgcgtcaagatgtggtgcaagtctcaggacagatttctctaccattactgtgatcgagaggctaccatgatgataatattaatctattattcatgaaactacttgctatgtgatattgacccaatcttttaatcagtttgaggtttggttttcttacctatgtgtataatcatactcaaataataaagtattttgagacctaaattaggtaaactgtgttaaaacacctagctcagaacttgacacataataaactctcaaaggtatatatgttgaatctgaaaccagaaagttgatagaaaattgaactcatcatcactccaacccgagaattgcttcttctcctctgtcctctctctttaccagctgacgaagccaaaatcctagaagttgtttatctcctccctctacttggcacatctaatctcagcccagtcctgtcaaaacagttcacttcttgaacaccacagccattgcctccactaaggcctggaccactgcaaagctccttcctggatcctttgactccccagtgcactctccgcactgcagccacagtgagcttttctaaatgggaaatctaatataatttactttctaaaatccttttcccctttgcataaaatctaagtttatatcatgccaaatcattcgtgatctcaagaaacataattttacgtaacctcccaacctcaaaactcaccattcctctctttgaagactattctagccacctaaatctacttgcattctagatcacatctcctttcctcaacccacgcacttggccctgcaccctttcacataccccttaaggttcagtcacctcctggaagaagccttcctgaggctgggttaggtacctctcccacatgctcccataacagcctgttctatgtggcacttcccatattcatagtccctggtcattctcaatagttaatacgtttcttaaagacagagatatacctgacttgttatgttatcccttgaacacagaatggtcaatagtacatattaagtgtttaatatctatccgtttggatgaataaatttaaaaatctgttagaaacatatatcttttaagcaattttgtgaattgcttaaaaaatataagtttcttctttgactacctttgaagacaattttcagatgtgtgatcttgggcaggttaaacctcttgttatgattatttgtctgtaaaatggagataacaattatacctacctcataaagttattgtgaagattaaaagagttaacacatgaacatcgcttagaactggccttgaaagtactcaagagctctcaataattgctaataatctgtttttatcactgtcactcttgctgttattgttactcttttcctgtaagatgggtccctttgtgtttggcacctgtccctggctcaagacagatttcgcaaggctgtaaattaaagaattgaggaaatttataagccagaggtcagcaagaaaaagtcatgagtcttctgatcctcccactgtccccacagagaggccgggaccacatgctctactggatgcattgtgggtaaaatttccaggcaagggaacctacccgctcatcactcttacaaggcatgcatgagagcaactttgtcaagaggcttaagcaacctgcttaatgctaagcattctagatttggatgccaactgtctacaggagttgtctgaagctaaggacctggggccaatggaaaataataaccctgtggacaggaggcagaagccacaagtcttacaagaagctgggttttggtcaagtacctacctcttagagaagagcaagcttccagtttcatctggctccttgtccaggaaagccagagtgagtttatgagatcatttttggacaaggttgcttgatgcagcagtttttaaatcaacaccttcttcagagaggacttcaaatgccatcatgcttatactttgaatctatttttaataggttgagacactaagttttccaagaatctgctcctctatcaagacaaatccaaaaatttcttctaatagcatttgtttaggtcaataatatttattaatgtgtcaggcaatgtactaaacgataagcatagaaaatttagaagtataattcctgctttcaggtatgtacagacttagaggaaaggcagatgaaaaaattacagtacaatgttatggatgcaatcatacatacatgcacaagactcagaggcattaagaaatgactctgttcagtttgagattatattgtgcaaactatgaaataaataatttttatttacccagaatattaaacttaggatccaagtaaaaacattgaagtccaaatagcagatgccatgacaaaagatagcatggtaatcactactaaaattgtactgggtgataagaaattggagaggaagatgttttatcatgagaactaaaaagcatttctggggagtggtcagaggagaatgttgtaagttaaaaggaatttagttcaaatttcaaccctgccacttactagctatgtgaatttaggcaagtttccttattcctctgagtctaaattgtctcatttaagaaatggggataataatatctaccatattgagctattttaagcagtaaatgaataaaaatatgcaaagtgcatagcacatggtagataataaaggaagctatttctttctaagaatataacctcacttgtcacctattttattccatgcgtttataattagataactggaaaattgactatcaagcactcctagagtgggatttcaatgttgttttaaaatggaattctatgctatttctcttagttgcttctctgagctatccacaatagttttaatgcattgcaagtgttttacacacatcctgccttaataaaacatgtaacgaaatcttaaaacccaagcctagttgctagtgaaagtagtcagaaagcagatgagaaaaatcctgttcagtaataaaatataaagtgaatagaaaaatgctagcatcctgacaggctaaagtggtctggtcaaaaagacaatgatgggattatgagaaattccctattactaaaaaagctaaaacttagcagtaaagaggttcgtgaagacatattcttccttttttacaaacagcctctaacataaattaagaatgtgttagtcatgtccaatagtgtaaattttaaaataaatcaaattgcatttttatatttctgtatttttgagagggacagaggagggggaagttaaattttgcctgtctttaaatattagtctgttcctccgttttccaaactcaacaatggtgacaataaacactttcttttgtcttttccctggagataagaataaatgttcacacggatacttttgaacattttatgaaaacctaggctacataaattcagggtcagtattatcatattgctaggaaggtggatcatacactaaacagatgaatttcctgccttatcttgtgatttccttaagtaccaagaaaaatagttgttatcttgttactcttaactttgggatcttatacagatacatttcccgagagctgcactgttccatagagtagccattagacacatgtggctatatacatttaaatttaaattaattaaaagtaactgaagttgaaaattcagtttcttcattctagtagctgtatttcaagtgctcactaaccacatgtgactgtgtgctaccatgttgtagaaagggaacatttctgtcatcacagaagttctgctgaagcacactagctcagaggacactcaagctaatgctcctattgccctatagccttaagctagccagtgatagcattttaagaattaaatgaccttaggaggtataggagtatgacttcataatcaggtcagtgtcagactaagggaaagctaaatgtaagagaatagaaactaaattaatgatgaagaaagaagggatgatggttagaaacagggtacacattgacattatcataaaaggataaaaaatgactcaagaaatcagtgcttcaacagaatttttcttaaaatttttacttaagacatttgttatatgttatttgcactaaatgcatcaatcacaatgctgactttctgatgtttatttgggttttgagatgttccagctaagtcacacaaaaaattatttcttaaggttgtagggaacttaacctcctctatactggtagcacatgtttaaaacatattttcctctcgtagggtgagcagatgctttggagctacttgcaatttttgttcacagcttttgtatttatccttatttaggtccttgtactcacaagtagttttcatgcttaccattattttggcttcttctgcttgtaaaaaaagaaattatagcatatgtattactgcctaaaaataagagagtaatctgtatatgtttgcatttaggtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtgtaagaggcataatgttgagtttttttcttcttgacaattatggtttctttcaggctatagataataataacaggtagaaaggaaaaaaatgccttgataaccatctagttgttgactttgtggaaaccatatttcatttatcagctgaaaaaaagaattattaacattaaagtaaaaatggactcttttaaaaaaagataacagattccccttccttttctctctctccaatctttctgaattactttgtttttatcttttcctgtttgggtctttgatatttacatagccttttaaaattgattgatccttccttacctttagaagtagagagagagagagagagagagagtgtgtgtgtgtgtgtgtgtgtgtgtgtgtgtgtgtgtgtgcagcccctttaattttcttgcctattctatgttactgtccctgaatttgaaatggcaagccagacaggggcaatttgtgaatcagcccagaggaagaatatttcctgctgatatgatcacatctagttgttgttactctccattcctaaaaccagaaaagaacagataacaagacaagaaaatggaggcactcatacaccattttgtaaaagtcagtagacttgagaagatctactcacctccctgtgaagagcaattataagaggaagagtagaaaaaaaaagactatcatctatatctgaaaatattacattttaaatatcattaagttaaaaacatatttctttatttagaaaaagttggacttagaaataaccagtgcatatccaaagctcaccttcttcactcaggggatggctggggctcttcagacattcaccttcagatcacaggttcaagccagtgcaggtttttagtgacagtaaggctgaggctcttcaaggactatttgaaacagacctcagttcacagcagagcacttaagagttcacctataaatcactaattggcagcctcaataaagtgaagccaagcatgaaatagctagagattaaactattactccggcccatcttccctaaagaagtccagcacaggaagcagtaaaggaaggaaaggcactttggattttatcatgaaaacaatggacagccatggaaggattttaagcaagggaacagcatgattacgtttgcatttctgaaagatcactctagggatgatttacactgtgagtgcaaaacaaggaacaagactggaaacagagacagttttatgttttcagtaactaaagctagaaaagatcagggcttgacttctgaaatgggaatgaggttgggggtcagaagataagagaattttattattattatcatttcctaataataagtaataataacatttattattaggaaaaccaatgcatcttagtcactgtttgaatatggagggagggaggagaaaaagaatcaaagatgtttgtcaagtttctttcttatacaagctggctgatggtattaccccagagagagggagagggacaagtttttggaatagaaatgagaccatttgaacatgctgagttgcagatgcctgtgggacatctagacagttatatttataggttgaacctcaggtaaaaagatctggactagagatgtagatttgaagatcatcagcatatagattatagctgaagctttaactgtagttaagatagcccacagagagtataaagaatgcatataaatagtggaaaggatgaaaccctctaatttaagacatgaactgaacaaaaagtacccaaaggaaactgaaaaagagaagccagacaagtaatcaggaaaagagggaagagcagtatcatagaagccaaaagaggagagagtttcaaggagtataatgtccaagccttcacaaaattgcagtaaaataaaacatgaaatgtctccactggattcagcaaggagacattcaggtgtgcatacacaacctttggtacagcattttcaatacagttgcataagacagattacaatagaggaagagtgaatataagctcagagaaaggagcaatacataataccaattttttttttttcaagaaacctgtctctgatgagaaagaaaagtagttagaggaaatgtttcttggtttttgtttttatatgagttattgaggtgacttggtcatgctgtagtattgaggagaaagagctagtagtgagtctgcattaatggaagaggatactggcatctataaactgaaatcctttaatctgggccccttgttgtggtatagagttaacagaatccacaatcagtgcccatcaacaaagctgtctgactgtgctatagctatagaagcaggatgtaaaaaccttctttttgaagaaaagcagataaaacaatttcctctctgctttttcaagattatgaatgatcatcatatttggaaaatattgatgaagaatgtaagatgagaaagtgtcaaaaagtaacagggatccagaggtcaagtcaagatgagagggtgtatctgagggccagagatctgtgatttagtgggctgttcagcaatccagcagaagagccccatgagtggcaagctctgagacagcactgcagcacgcaggccaaaagttgggtgctttatataaacttggcatcttgattcaattctaaagtctgatctctgggaaaccaaatcgaagtttttgtgactgatttgctatcctcatttctgacaaagacatatgtgatactgcttttgccattaatatacttttgtttgagaaacaaaaagaatcagtgttctaaggttcacatgcctgaacctttatcagcgttctcattttcacagcagcctggatgggttctcctgctccaccctcttacttgcaataccacccacccactctgttcctgattccagagaactgagactgtttagggagaagagacacagtagattaaaggatagcaatattacctaaagaatgcctgttttatgctcataaaactgtgacactgcttctctatctcccaaattgcagagcccagttgtctgccccagagtgatgctggattaaggaaacatgacatatgtagaatttccatcttttctcctgtatctctcaaacctgaaaaggagtccaggtgtataatccactgcaactcttcttaaattctcctgcactttccttttgtgtagcatccccaacccccagatttctctcacacttatatgctgatattactctctcatctgctaggtccccatggtttttattccattctaattgcttttttctcaagactcacctgagaagctgttatcctttctcttgacagagtagtaaggggaagaaattaaagtgacaaagggatgaggaaggccatgaaatccacagtttaataattttatactaacatattgaaaatgtaataattttatactaacatattggaaatttcataaacctatatctgcaattgttcctctcaaaggtcagagtacctaaattgaaaacatgttggtcatagaaggctttcattatttggtgcagcaaatattcttgtgcctgacacactcccatgggaatattcagagctctgtgcagttcccaacatgcttgctttctctcctactcaagaaagtgtagatataccatataagtgaatgtggcagtattataagtataaccctaaatccaactaacagtaaaaaactaatttgcagaaccactgtattaatataggcagttatcctttcataaatgtgaatttcaaactaccctcacattcattcactttacaataatgccttataactgcctttcaaataattatttgtagctgtcatgtcatgcacagcccttgggagaaaggacccagcttaaggccaaggttgtgtgtagaacagcatctggagcagtgcctggccatgcactttaaaacacctttttctccctctccactaaccctcaggactagccttgtagctgctcccaaccccaagtattttcccactttgtagcttgatagctacatggtgacccttcacccagtcctacctcccccaccctcacccacattgtcctacacatttattctgcattgtcttcaaccctcgcccctgattactccacacatggaagtctactgagtgcaccaggctgtagtcagctggtcagtatcctttaggacagagtttcaatgtaatgggaaaataatgctttcttctaatccctgctccaggtccccagcatgtcactgacaaagaacttgacacattaggggcttcttgactatcagctcaaatgtggcatcccaggatgggcagcagttgtccagatgttggctacctcagaaataatgctttgcctaggccaagacaccttatgtactgtatattgttactacccactgggccataattagggatcttataagactttagcaactgcaactaccagcttctgtagtacatattagtctatcttgtaactttaaagcacttagtttccagtaatatgtgaatcatgaaggtagggaaaagcccataccaataccattatttagaacctcttctttaaaaaactgtgaataatgctgtaagactgaatagtactatctctctccatttagctaattatgcaccaatactgctatcttctgaatacaataacttccaacattttgatataaaattttctacttattttgagaagattttgttcaatgccacataggcaatacataatcagcatttgctaaattgtttatctctatacaccaagtcatagacaactttttttttttgattcttgttgctagcacttttaaatatgcttttcatgacagagaaataactggctggccaaaaccaatgttgaaattgaataataagcaaacttttgtggaaggaagacagaatatgaaagatggatcaggagatttgaaacttctatttgcccattagaaaaatctaaattcagccaggctcagtggctcacacctgtaatcctgaccctttgagaggccaaggtggcaggatcacttgaagccaggagttcaccagcctgagcaacaaagtgagaccccatctctacaaaaaattaaaaactaaaattagccaggcatggtggcacatgcctgtggtcccagctactcgagagagcaaggtgggaggatcacttgagcccaggacttcaagtctgctgtgcactatgatcatgacactacactccagcctgggcaacagagtgagactccgtatctaaaaaaaagagaaaagaaaaatagaaaattcccataaactgctggcacaagatctttataatataatgtcaatatccatattaatactgatacaaactcttaatatatattatcaacaataactatgactgccatttgttgagagcctactatgtgccagttgtggtactaggggcttttattggttatgtcacttaatcctcactgttattattcccatcccttagacacggaaacagagacataaagaggctaactttcccaagagtacacagcaataatgagtagatcaggaatttgaaggccactgactccaagtccttgctctttccagtatacaacatagaatcacacagaaaggcaagatgtttgctagtacaacactgcttcaaaaatatgattctaagaaaagggggtacattttcacatttccagatagattttatctggactagtcaaacttcatagatggagtctattaaaattcaaaaaacaattcttactggagagcagcctgttattttatgtcccagtaggcaaatactagaatgtagagaatatgaccttagtcatgggaataaatagaaaatacatagtccatatatcccccaaacaccctcccacaatgcccagccacttgaagaacattacttgaaaaaggaaagtagtaatagcaacaatatagagaaatgaggaaaatatggcagtaacatcacataattccagaattacgtcctcaggcatttctgtagattgaatttttctggtgctggcataaatacgttttgcttctttttctcactatggcagatattactaatcatcacaacactctcctgctgagtccagattctgccttagcatccttctcatgacaacattttgacaaccactgccaatgaattgcagttggcatgtgacatgagacctattttctgatcctggattacttcctcacaaaagcaggcttttcttaaggttcaggggtctattactctggccgtaggaaccatgtgctgggtacactactgggaattatgggaaattctttataagtattatccctgctctgcatctgttcctcttaatgttcaaacatatctacaactttaaattttactttgaaattttaattttcattccttcatatttttcactagttatcagccttattatgtttaaataatcatatcaataaaaaacaattgaagacttactgaaaataaaagactgacaaaagataattaatgtccttaacactgtggagttagactgtttgaaacaaatatatattacccacaagcacaaaatatctgtatctatatctatatagtatatgtctacgcatttgaggtttcatagccctttgagtaaaattacactttaaaaatgttttaaatatcaaaattatttcattaatttaatgtgttcacattgaatgttaggcttaattgcagacaggactttttaaaaatatatgattatgtaaattcttcttccaagggtatgtacatagtgtatgcatgacaaaattatttcatggattaagtgaatagtgtgaagtgcagtccctgagtcacgagatgaggaactcatgtaaaagcagccatattgcattaagtcaatgtgctgttgttgctctaggtctggttataattgcaggtgaacccttaaccctaagctacccaactccacctatcactgcctctttctccactctgaaacctataaagacagaataaacattttcgcaatacaaggaataatttgaataaacagcatattatttaataagttgaccactatatcaacaggtacttactcttctaggttctttatttattggaattaaatgaaaatattcatcatgaatcagccatcatgttatggaccaaactgttctgtagataatttaatattcaagtctgagtcatcacgtatttaatgaactcctataatgttttcagcattatgtgagtgcctacacaaaaacagagagatgtgttcctgccctcggggagttttcacttattcttttaaaaaaatctgtcttatgaatttttcccaaagaagttattcaattgaaacaaaaagaaacatgctgtaagactacatactcatgtctactaaaagaatgttgttagcaacctaagagtctaactttagagaattaacaaattattaagcatccacatatagaatagtatgcacccatttgaatatgaaaactgctgaaacatgggatacattcatgaatatgtgaaatgaaggcaatgtaaaataaaatggaccctatctgtacatttctgctaatcacatatacatgtattagctaggaaacaagaagttgtgttagagtgcaagagaagaaaagcctttaagcattatgagggtgtcatgttaaaacagaatcttagcttgcaatagtgtttctcaaaatataacctttcttgaatcattttagtatgtctattactattatatatttatatgatgaatataaaacatggaaaactttgaggataaaacacttcttgctttttaatggtagtattgatatatattgatgacctatctaaggaatttctaagttaaaacgctagtactattgtgaactcaaagggctcattagagtaaaaacttctggactcttaccagagctactcatttttaaacatattttattgtattgaaattttatatttattactaaactgtaacattacctgtaatacctatactccagccctttctataatctaaattaaccataattttacctgaaatatcctaattctagccccattctcatttttctgaggaaaaagttgatccttgaccttctattctacaataagtattttttaaaatgtgagctgcaggttttgctgtaaagatatttctcaggtgggcagtactcactaatcaccaaatagcacaaatttctacatgcttagcaaatagcagactaaatttatcattgtacatgtttgataagaaagggcatttattgtttattaggtaatattccagagtaattcatgtgaggataatagtaccaagccctcgaagccagaaaatagcaacatttttcaacttccttagaagataaggtgaaagaaaagttattgcacagtgtctgtgaacaatgaggggaccctgaccttactaaatcaactgccaaggcagtcgtataaaggccaaagagtaactaggtcactgaagatgcgtggagagaaagggaattatggtattaaagcattctggaagcaaatagcagatgcttttcaacaagggaaataggctatttaagtcatttaacatacagaatgtccttccatgaccttttatactaaggacataaaattagcaatttacatttccactcaccaaatatatgaaattgtgaaatttcaagagtgattccagtgttatctcaggagaaagaagtagaagtcatctgactatgtcggtgcatcgagaatggcataggagtatgaagggaaagtcactttaatacattcttttaattttcttcagttttaacgaactactttgacaagtatttaaaagacaggagagtcacgttttgaaataggacactcaattttctaacatgtggttttatttatgttaacaagcaacaaggatatcctggtcattttgatatttaaacttggttagtgaagtatggtatatcccctgaaactggtcaaataatttagaaaaataatgtagaagctattctgaattatcttacatatttacaatgcacattagagcagtgaaaactctgagaaatgctacaacttaaaaatctgcttcacaatttttgccatgaagacctttattattttgtattttacatatgaaattttattttacaatattgattaacataaacacctctaggaaactttgaataaatacagcaacaattcaagtatttgttggtagatgctatgatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaatttatgttaattcccaatcatatataaaagaatccaaccccccaccctgtaatctctcttcaccccacctccaccttcaagctagacctcagtttagaaaaaggtaggtcaatgtagtaataaaaggaaaaccaaataaatgaattctaggccttccaagggcacctttcagaatcttcaggagttgtaccatatacaacttgtgctcctaaaagactcgggtcctggtgactttagggtgacttaaaggatttttaagggtaattttgatggttagggaatttcagtttttaccttaagtattaaccttaggacctaattcccatattattagtagaacaataccagggttatatagcatgtatatgcccttctgcttcacagtaggggaattcttacttcacatggtgtaatcatttgtgctcgtagcttatcaattgctagttaaagctgaagtagttcaaatgtgaatggtaaaaacactttgataaaacagtcgaaatatgaacattaaaatctatggctctaattgtctttgtagattctttcattctttaactttataaaacttaaaaaacaaagtaaatgaaagttgaactaacttcaatattccaataaaaataactcagtgattcacttctaataaggaagtttttcattacttacaacatatcgatttcactcaaacactaaattttttttaaagattgttactgctttactagttaatataaattacagatctaaaaattctttaaatgatatatttattaccatagagcttttgtgacacatttattactataaaagcacttttaccaccaagtattttttaaaacatgcaaaatattttaatgtgtatttttatgtaagtatgtaaagaaactaatacaatttattgtcagaatggcttaaatacacaattctgagttacttttaccagaatttataagattaattctgtttttattctctctgacttaagctattatatataactatttcatatatattgcatataaatatgtgtatgtaatgtatatataagcacatgtataccctagcctttccaaagtaatacttttatacttccccttgcatcagatctgagaaacaaaaataaagattgctatatcattgcctttaagatccattttcttgttaacccaacctaacattgattttgtgttgttttgtgccttattaatatctgtgctttggggacattaccctagcttgtatgtgtgtaaatcttattcatgcaactgaactctgtgacaataaaaattacattttaagaaatgataaattattattgaatgtttgagaacagacaaatggaagtttgatcaatgaattcaccataagaaggagaagaactatcacagcaaatgtagaaaaggacatggattcaggggtaggtcagacaggggaagaatgaacatcctgtggctactctccttgtggggataagggatgggctattccttaagtttcaaaacaaaattttatgcaagagaaaaaagtataagaagaagggggatagcaagatgtgagttctctcaacatccatcataaagaaattaaaaagaaaaaaaagatcaatgtaagtcccagtcatagcaaaaagcacaaaaagacaaaagtgttccaccagataagtcactgatttgataaataattttttaaagtgactgatttgaataagatagaaaatcagaggctttcaaatggagaataaaaacattagatgtaagaatattgtaaaagtaaaaataaagttccgtgatttgtgctttatttggcttttaaatgctctccatgttttgttttgttttgttttcttacagaatgccagagtcccctggtgaagttccggaatatcctttgtttgtcacagttggtgactggctagattctataaagatggggcaatacaagaataacttcgtggcagcagggtttacaacatttgacctgatttcaagaatgagcattgagtaagtgatactaggtttattactgtaacgagatgtcctgctggggattataagttcaaatgctgtatcaagaacacctttccttaggctagtgggtaatttccaagtctttgctcaccatttctgactatcattctagtgggaagttggacattacacttttagctattattctttgaaagaatatatttaattcaaatagctatttaaaatattttaaatgttttctaaaatgcatgttactctcatccaaatcatagactttatgtcaacttaattttaccttggcaaattattactcacatatattaatattgcataatcagtttctattaccttcatcaaataatgcaatattatcatgtcattttcagagctccttctagatattataatggtcaaccattttccactattctcaaagattgtcttttgcctacatgcaatgaaaatatttaacatgtgcttaaaagactaaatggttagtttgaatcatattaaattgccattgttttaagacagtaatggcaatttcatacagtacaacctaagggcattttttctagatatcaaaaatccatgagaaatcaaacggagttcatattataccttccatcctacataatcaccattttgctaatactgttgcaaatgtatatcattacctaaattatatagcatttacgcctatgaaatatctgagtattacataagtacctgtgtataaaattgaaatatatatattattacatctgagattaactttatgtattctgtggatccagagaaaaggaaaaaaagaaacaaacttttgctgctcatttaaatctctgtttaacaagtaagctacactatttttggtaactgtggcagagtgcttatttaatatatttaaatattcactttatcttgcatgcttattagatctgaatgttcatattctgtactctctctctctctctctctttcttgctctcactctcgctctcactcttgctctctcctttctttcagtgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatggtaaataactcagcatggatgtgtaattttgtataagccgtatatgggaagtgttcacggacttaacctaaaaaaatttatccaggtggggcttccttagtgatgtatgtagagtgtgatggtagatgagaaagaactagttgacctttctttcatgttttgtgatcaagtagcttccaaactgacagaaatgtttcatttttagataattatattcagctctattggttgtattattactttattttttaatactttaactgttggtgcctgatattgttagaattatttgcagaaatgaccagtgatatcatgtaatgaatttttgtgaggtatgactatggtgagaagggggttattagggagggagaaaaaaatactgtgtttataaatcttctgaggctgggtttgtcaattttttaaaaattaactttataatgtcatacatatttcatagtaggtggtagtttaaaggcttttcacctctaattttatttatttatttatttatttttactaaccgtagtatatttctctactaccttatgaagaccgctcctggaaagaccaagggtgacttcattgatctaatggctttcatagagaaaagcttgggataaatccatgactatttcctttgtgcattgtcacaagtttgcaaaagcaattatcaaagcactgagaaaattggtcattctcagtagaattgctttgaataaaatacgttagattatacccttagatttaatgtaaaattattaatttaatttaaacagaactttatgatagatacatggtggcccaagaaaataaacagacttagctgatcatttggtattggcacattttgcaagttgaagcgttcttatgttttctttgcaaaaatagttacatgaacatgctgagctcttttcgaaaccttctaagaaataagtatgaatactccaaagagcatataaacagatcttacacatgagcatagtgtgtcaacctgggtccaacgtacagttacataaaaatgagaacacagctgtgttgtcataatcttctgagaggcttaaaaaacaaaggtaaatatatattttaagtgatttaagctgagttggcttatcaaaattgtgctatatcttatgaacaaattaaattataaaatcagctgctccctgtaaaactaaaaaaatgacgactgttttaggtgaaagagtaagtaaaatgtgttgagagaaaaaaacagagtaggttgtctaaagatgctgatttaataaattagcttttgttggatctcagtgataatggtgccctacctaccctaattctcaaattcctatctaaattcattttttgtcatagtagtggttttttttttttaaataaaggaccctgtttttgttttttgtttttgtttttgttgttcgtttgtttgtttttgagacggaggcgttttgctcttgttgcccaggctggagtgcaatggtgagatcttggctcacggcaacctctgcctcccgggttcaagcgattctcctgcctcagccacccgagtagctgggattacaggcgcctgccaccactcccggctaatttttgtatttttagtagagacggggtttcaccatgttggccaggctgctcgaactcctgacctcagatgatctgcccgcctcagcctctcaaagtgctgagattacaggcgtgagccaccgcgcctggccatttttttcttatatttagattttgttgatcgtcccattatact

SEQ ID NO: 4 - protein, 1035 aa, Mus musculus
MGGCEVREFLLQFGFFLPLLTAWTGDCSHVSNQVVLLDTTTVMGELGWKTYPLNGWDAITEMDEHNRPIHTYQVCNVMEPNQNNWLRTNWISRDAAQKIYVEMKFTLRDCNSIPWVLGTCKETFNLYYIESDESHGTKFKPSQYIKIDTIAADESFTQMDLGDRILKLNTEIREVGPIERKGFYLAFQDIGACIALVSVRVFYKKCPFTVRSLAMFPDTIPRVDSSSLVEVRGSCVKSAEERDTPKLYCGADGDWLVPLGRCICSTGYEEIEGSCHACRPGFYKAFAGNTKCSKCPPHSSTYVEATSVCHCEKGYFRAEKDPPSMACTRPPSAPRNVAFNINETALILEWSPPSDTGGRKDLTYSVICKKCGLDTTQCEDCGGGLRFIPRHTGLINNSVVVLDFVSHVNYTFEIEAMNGVSELSISPKPFTAITVTTDHDAPSLIGMMRKDWASQNSLALSWQAPAFSNGAILDYETKYYEKEHEQLTYSSTRSKAPSVIVTGLKPATTYIFHIRVRTATGYSGYSQKFEFETGDETSDMAAEQGQILVIATAAVGGFTLLVILTLFFLITGRCQWYIKAKMKSEEKRRTHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNGIQAPHPVTAGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPPSLQQLMLHCWQKERNHRPKFTDIVSFLDKLIRNPSALHTLVEDILVMPESPGDVPEYPLFVTVGDWLDSIKMGQYKSNFMAAGFTTFDLISRMSIDDIRRIGVILIGHQRRIVSSIQTLRLHMMHIQEKGFHV

SEQ ID NO: 5 - protein, 948 aa, Rat
MGGCEVREFLLQFGFFLPLLTAWTGDCSHVSNQVVLLDTSTVMGELGWKTYPLNGWDAITEMDEHNRPIHTYQVCNVMEPNQNNWLRTNWISRDAAQKIYVEMKFTLRDCNSIPWVLGTCKETFTLYYIESDESHGTKFKPSQYIKIDTIAADESFTQMDLGDRILKLNTEVREVGPIERKGFYLAFQDIGACIALVSVRVFYKKCPFTVRNLAMFPDTIPRVDSSSLVEVRGSCVKSSEERDTPKLYCGADGDWLVPLGRCICTTGYEEIEGSCHACRPGFYKAFAGNTKCSKCPPHSSTFVEATSVCHCEKGYFRAEKDPPSMACTRPPSAPRNVAFNINETALILEWSPPSDTGGRKDLTYSVICKKCGVDASQCEDCGAGLRFIPRPTGLINNSVVVLDFVSHVNYTFEIEAMNGVSELSISPKPFTAITVTTDQDAPSLIGMMRKDWASQNSLALSWQAPAFSNGAILDYEIKYYEKEHEQLTYSSTRSKAPSVIITGLKPATTYIFHIRVRTATGYSGYSQKFEFETGDETSDMAAEQGQILVIATAAVGGFTLLVILTLFFLITGRCQWYIKAKMKSEEKRRTHLQNSHLRFPGIKTYIDPDTYEDPSLAVHEFEKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNGIQAPHPVTAGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDVWSYGIVMWEVMSYGERPYWEMSNQDVILSIEEGYRLPAPMGCPPSLHQLMLHCWQKERNHRPKFTDIVSFLDKLIRNPSALHTLVEDILV

SEQ ID NO: 6 - protein, 968 aa, Chick
LLLLCAALGSAGRLSARPGNEVNLLDSKTIQGELGWISYPSHGWEEISGVDEHYTPIRTYQESNVMDHSQNNWLRTNWIPRNSAQKIYVELKFTLRDCNSIPLVLGTCKETFNLYYMESDDDHLAKFREHQFTKIDTIAADESFTQMDLGDRILKLNTEVREVGPVSKKGFYLAFQDVGACVALVSVRVYFKKCPFTVKNLAMFPDTVPMDSQSLVEVRGSCVNHSKEEEPPKMYCSTEGEWLVPIGKCLCNAGYEERGFACQACRPGFYKASAGNVKCAKCPPHSSTYEDASLNCRCEKNYFRSEKDPPSMACTRPPSAPRNVISNINETSVILDWSWPLDTGGRKDVTFNIICKKCGGSSKICEPCSDNVRFLPRQTGLTNTTVTVVDLLAHTNYTFEIDAVNGVSDLSTLSRQFAAVSITTNQAAPSPITVIRKDRTSRNSVSLSWQEPEHPNGIILDYEVKYYEKQEQETSYTILRAKSTNVTISGLKPDTTYVFQIRARTAARYGTSSRKFEFETSPDSFSISSENSQVVMIAISAAVAIILLTVVVYVLIGRFCGYKKSKHGTDEKRLHFGNGHLKLPGLRTYVDPHTYEDPNQAVHEFAKELDASNISIDKVVGAGEFGEVCSGRLKLPSKKEISVAIKTLKAGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDAWSYGIVLWEVMSYGERPYWEMSFQDVIKAVDEGYRLPPPMDCPAALYQLMLDCWQKDRNNRPKFEQIVSILDKLIRNPSSLKIITNAAARPSNLLLDQSNIDISAFRTAGDWLNGFRTGQCKGIFTGVEYSSCDTIAKISTDDMKKVGVTVVGPQKKIVSSIKTLETH

SEQ ID NO: 7 - protein, 953 aa, Human
SNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKHFEKDQETSYTIIKSKETTITAEGLKPASVYVFQIRARTAAGYGVFSRRFEFETTPVFAASSDQSQIPVIAVSVTVGVILLAVVIGVLLSGRRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVN

SEQ ID NO: 8 - protein, 975 aa, Human
SNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKHFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPILIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVN

That which is claimed is:

1. An isolated nucleic acid molecule consisting of a nucleotide sequence selected from the group consisting of:

(a) a nucleotide sequence that encodes a polypeptide comprising the amino acid sequence of SEQ ID NO:2;

(b) a nucleotide sequence consisting of SEQ ID NO: 1;

(c) a nucleotide sequence consisting of SEQ ID NO:3; and (d) a nucleotide sequence that is completely complementary to a nucleotide sequence of (a)–(c).

2. A nucleic acid vector comprising the nucleic acid molecule of claim 1.

3. A host cell containing the vector of claim 2.

4. An isolated polynucleotide consisting of the nucleotide sequence set forth in SEQ ID NO:1.

5. An isolated polynucleotide consisting of the nucleotide sequence set forth in SEQ ID NO:3.

6. A vector according to claim 2, wherein said vector is selected from the group consisting of a plasmid, a virus, and a bacteriophage.

7. A vector according to claim 2, wherein said isolated nucleic acid molecule is inserted into said vector in proper orientation and correct reading frame such that a polypeptide comprising SEQ ID NO:2 may be expressed by a cell transformed with said vector.

8. A vector according to claim 7, wherein said isolated nucleic acid molecule is operatively linked to a promoter sequence.

* * * * *